United States Patent
Brown et al.

(10) Patent No.: US 9,458,457 B2
(45) Date of Patent: Oct. 4, 2016

(54) METHODS AND COMPOSITIONS FOR THE SPECIFIC INHIBITION OF ALPHA-1 ANTITRYPSIN BY DOUBLE-STRANDED RNA

(71) Applicant: Dicerna Pharmaceuticals, Inc., Watertown, MA (US)

(72) Inventors: Bob D. Brown, Millington, NJ (US); Henryk T. Dudek, Wellesley, MA (US)

(73) Assignee: Dicerna Pharmaceuticals, Inc., Cambridge, MA (US)

( * ) Notice: Subject to any disclaimer, the term of this patent is extended or adjusted under 35 U.S.C. 154(b) by 0 days.

(21) Appl. No.: 14/323,299

(22) Filed: Jul. 3, 2014

(65) Prior Publication Data
US 2015/0011607 A1    Jan. 8, 2015

Related U.S. Application Data

(60) Provisional application No. 61/842,551, filed on Jul. 3, 2013, provisional application No. 61/891,548, filed on Oct. 16, 2013.

(51) Int. Cl.
C12N 15/11      (2006.01)
C12N 15/113     (2010.01)

(52) U.S. Cl.
CPC .......... *C12N 15/113* (2013.01); *C12N 2310/14* (2013.01)

(58) Field of Classification Search
None
See application file for complete search history.

(56) References Cited

U.S. PATENT DOCUMENTS

5,985,836 A      11/1999  Bastek et al.
2005/0137153 A1   6/2005  McSwiggen et al.
2011/0059187 A1*  3/2011  Basu .................. C12N 15/111
                                              424/649

FOREIGN PATENT DOCUMENTS

WO    2008/143633 A2   11/2008
WO    2012/178033 A2   12/2012

OTHER PUBLICATIONS

Rozema et al, Dynamic PolyConjugates for targeted in vivo delivery of siRNA to hepatocytes, 2007, PNAS, vol. 104, No. 32: 12982-12987.*

Hassan, Tidi et al., "Isolation and identification of cell-specific microRNAs targeting a messenger RNA using a biotinylated antisense oligonucleotide capture affinity technique," Nucleic Acids Research, vol. 41(6):e71, doi:10.1093/nar/gks1466, 13 pages (2013).

International Search Report and Written Opinion for Application No. PCT/US2014/045365, 23 pages, dated Dec. 29, 2014.

* cited by examiner

*Primary Examiner* — Kate Poliakova-Georgantas
(74) *Attorney, Agent, or Firm* — Mintz Levin Cohn Ferris Glovsky and Popeo, P.C.; Christopher R. Cowles

(57) ABSTRACT

This invention relates to compounds, compositions, and methods useful for reducing α-1 antitrypsin target RNA and protein levels via use of dsRNAs, e.g., Dicer substrate siRNA (DsiRNA) agents.

52 Claims, 29 Drawing Sheets

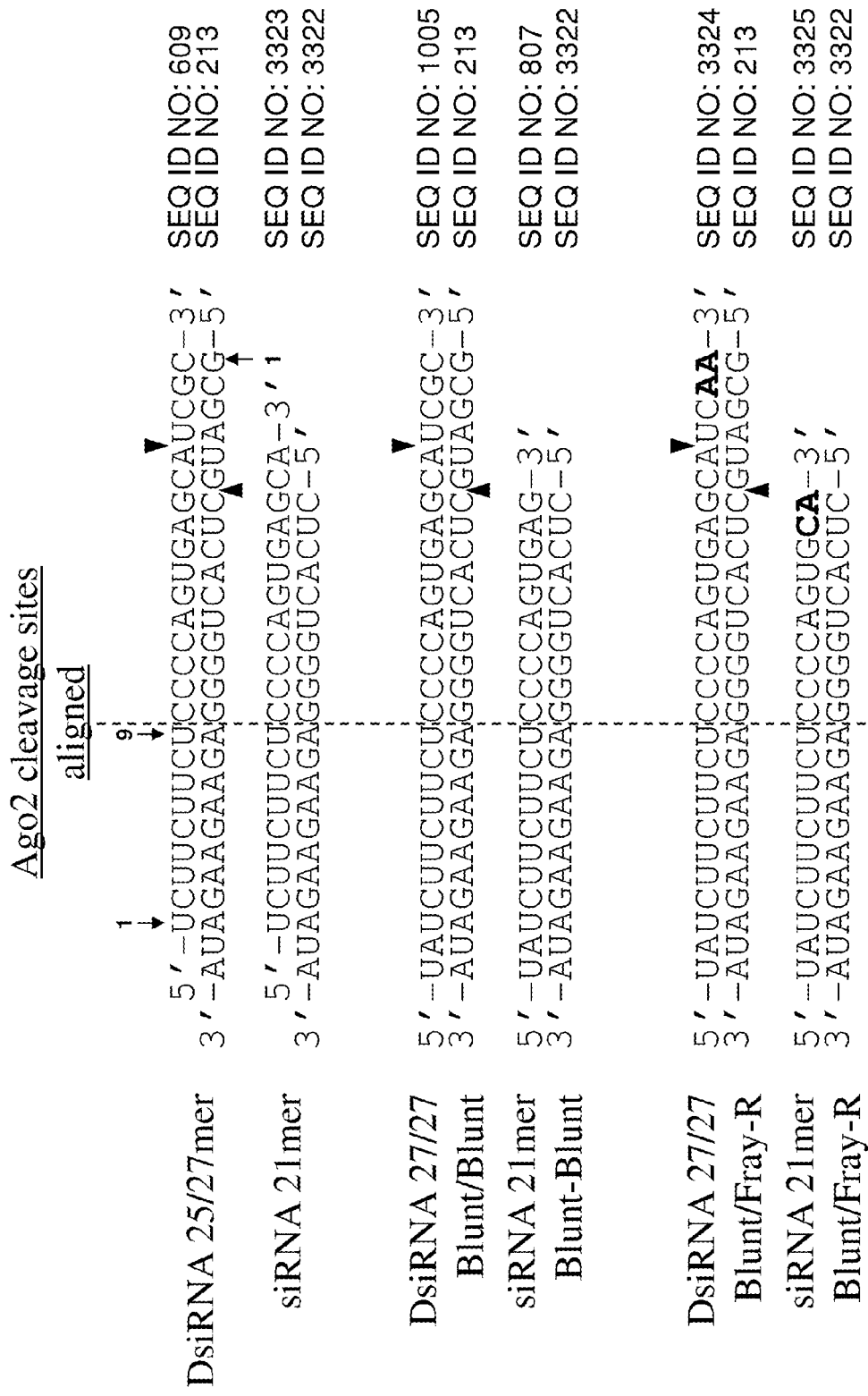

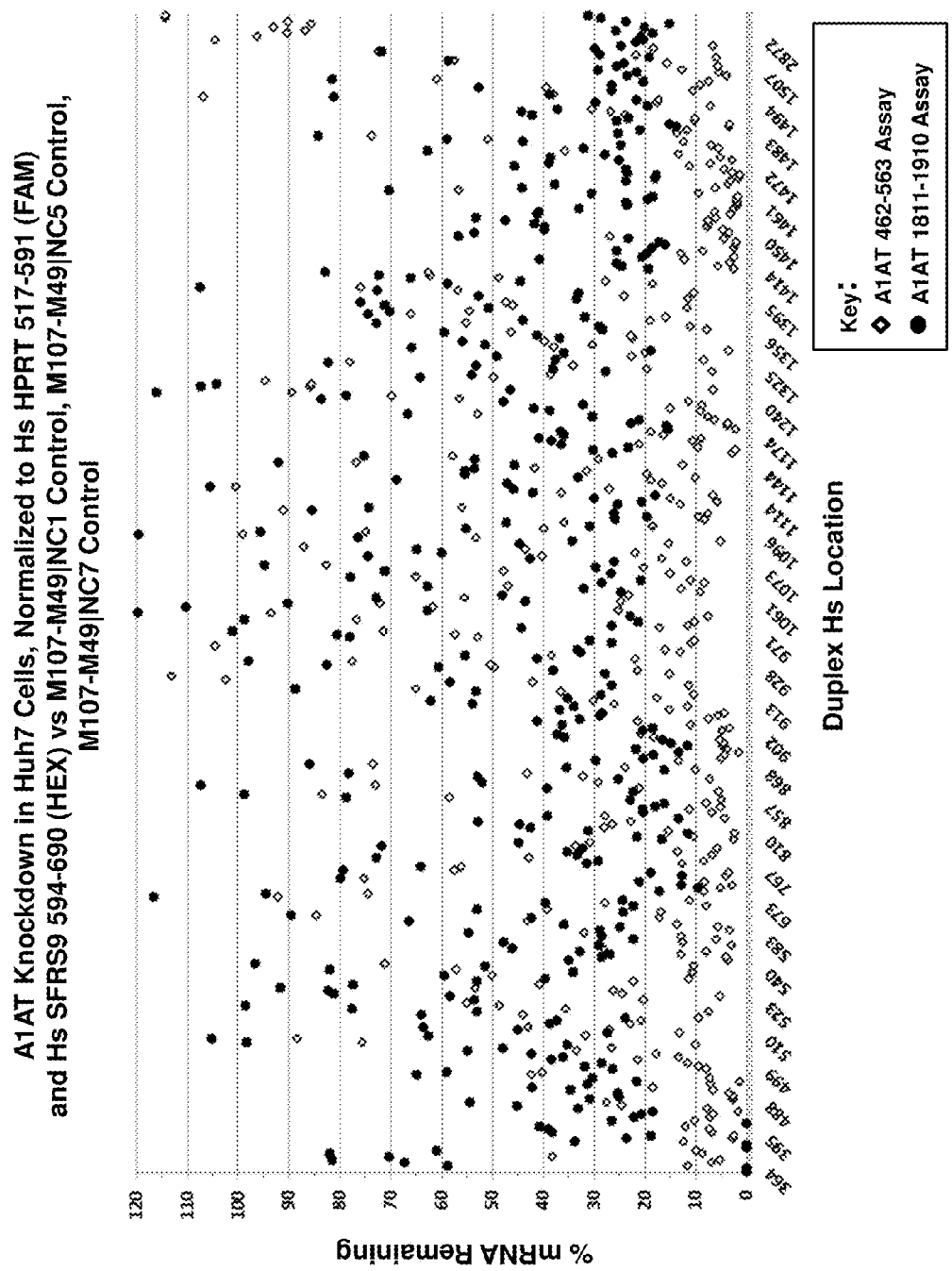

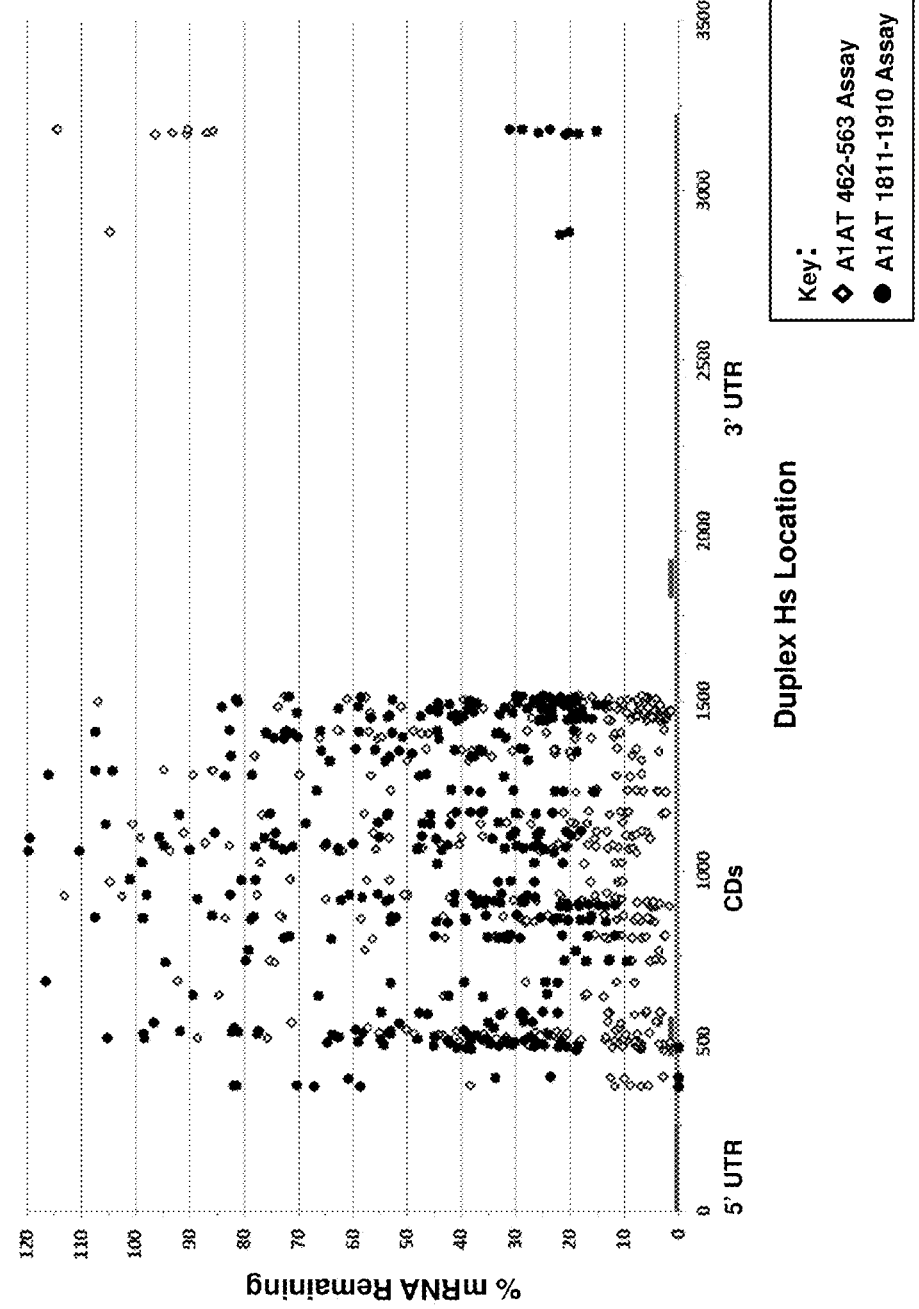

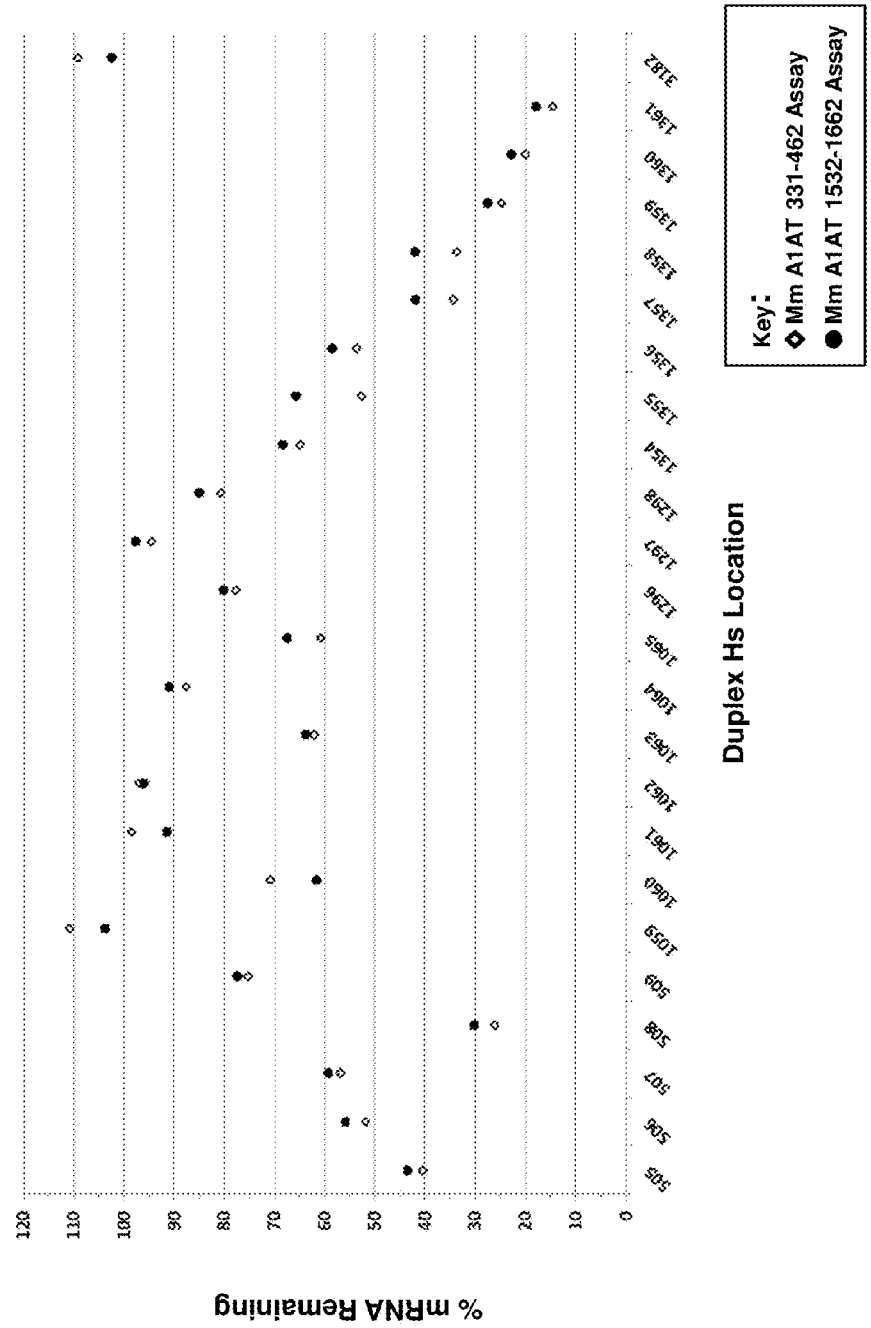

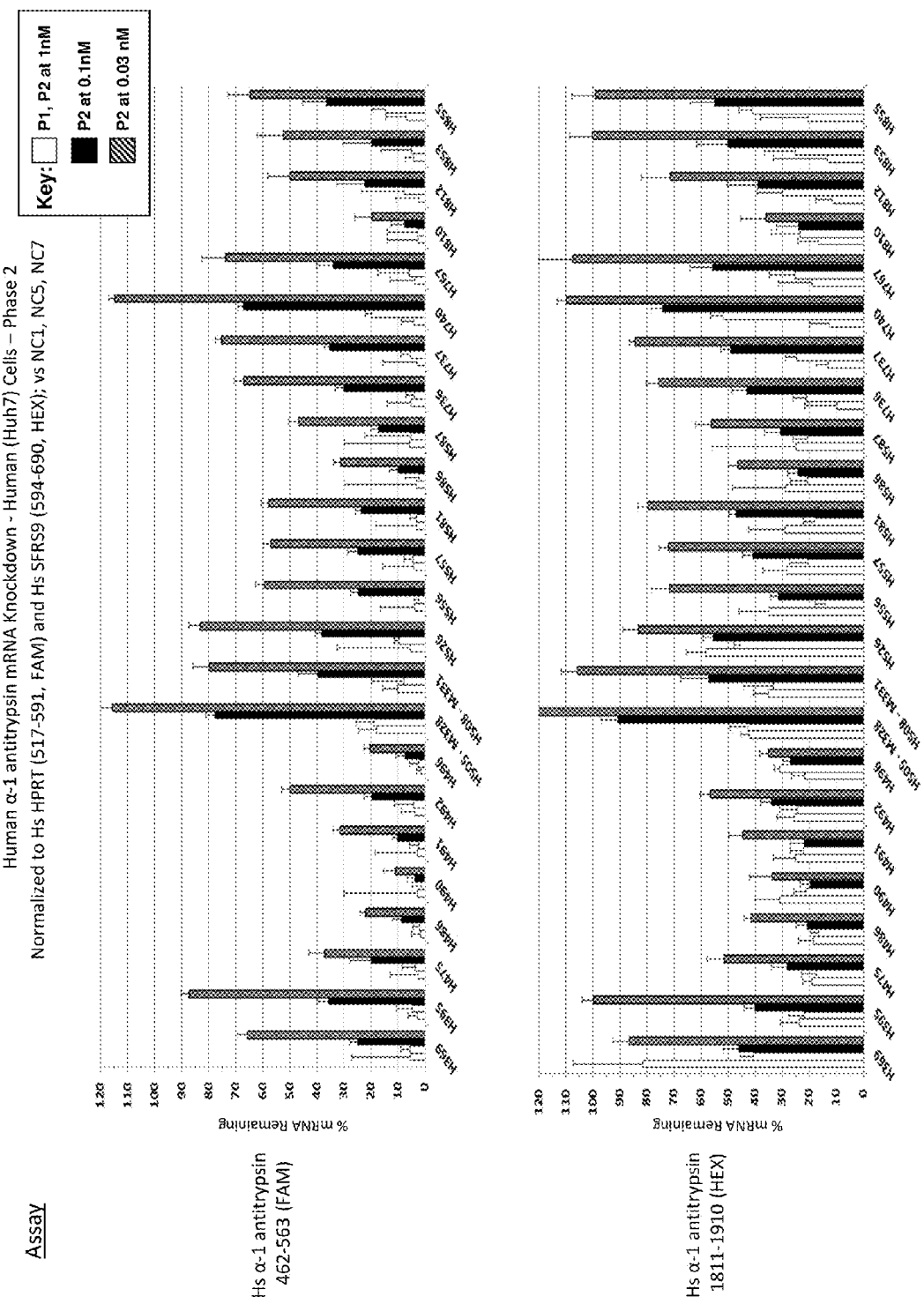

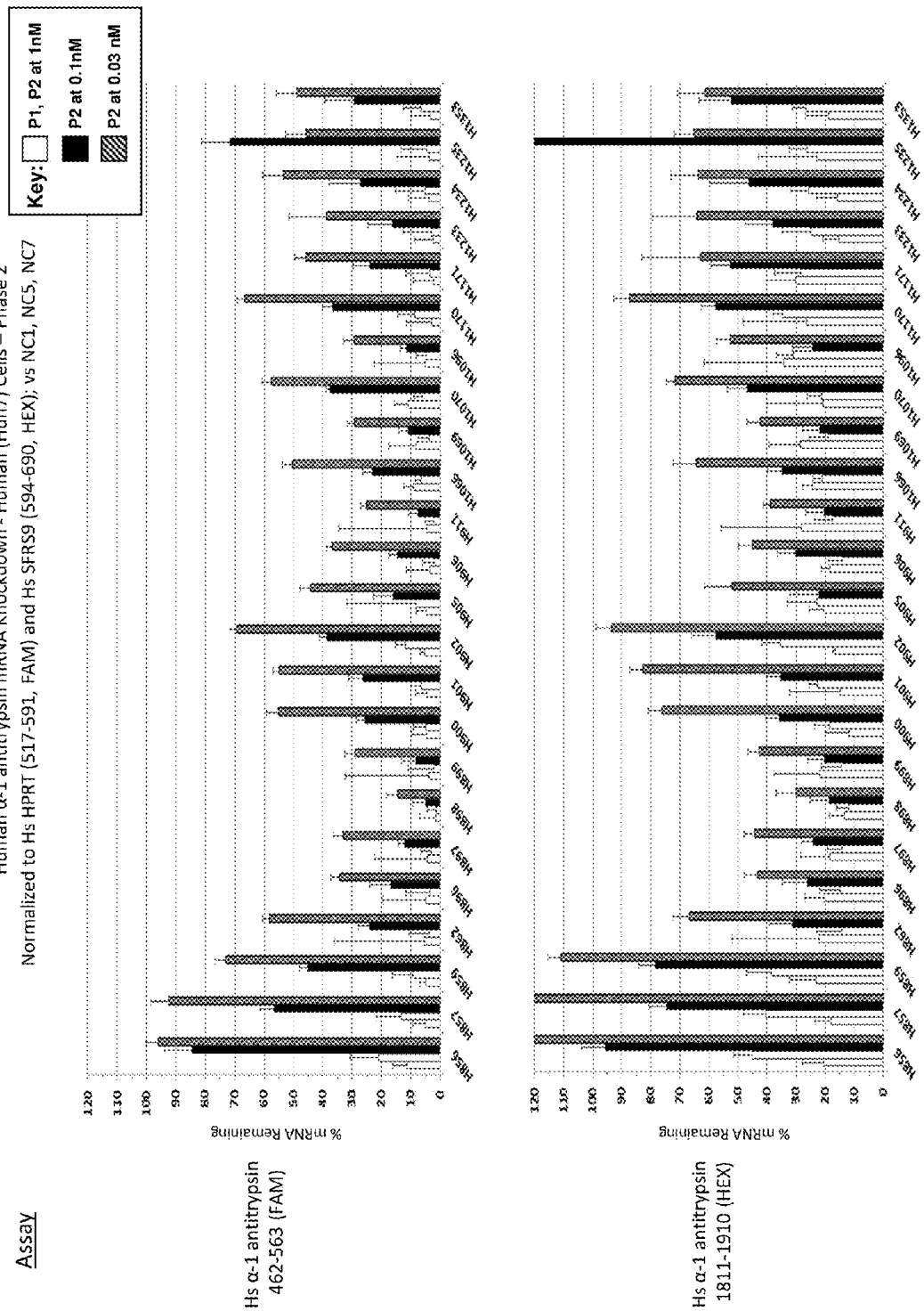

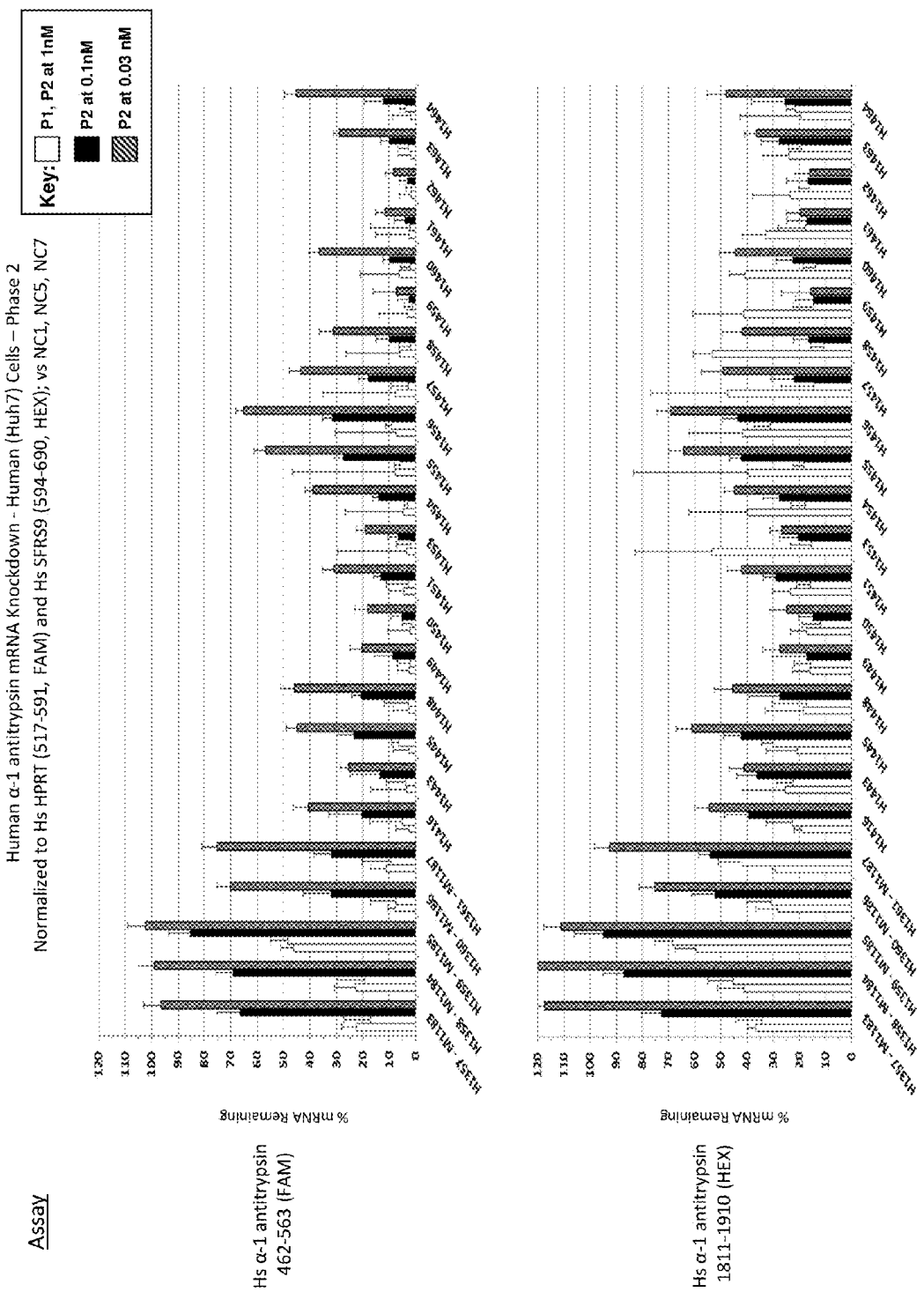

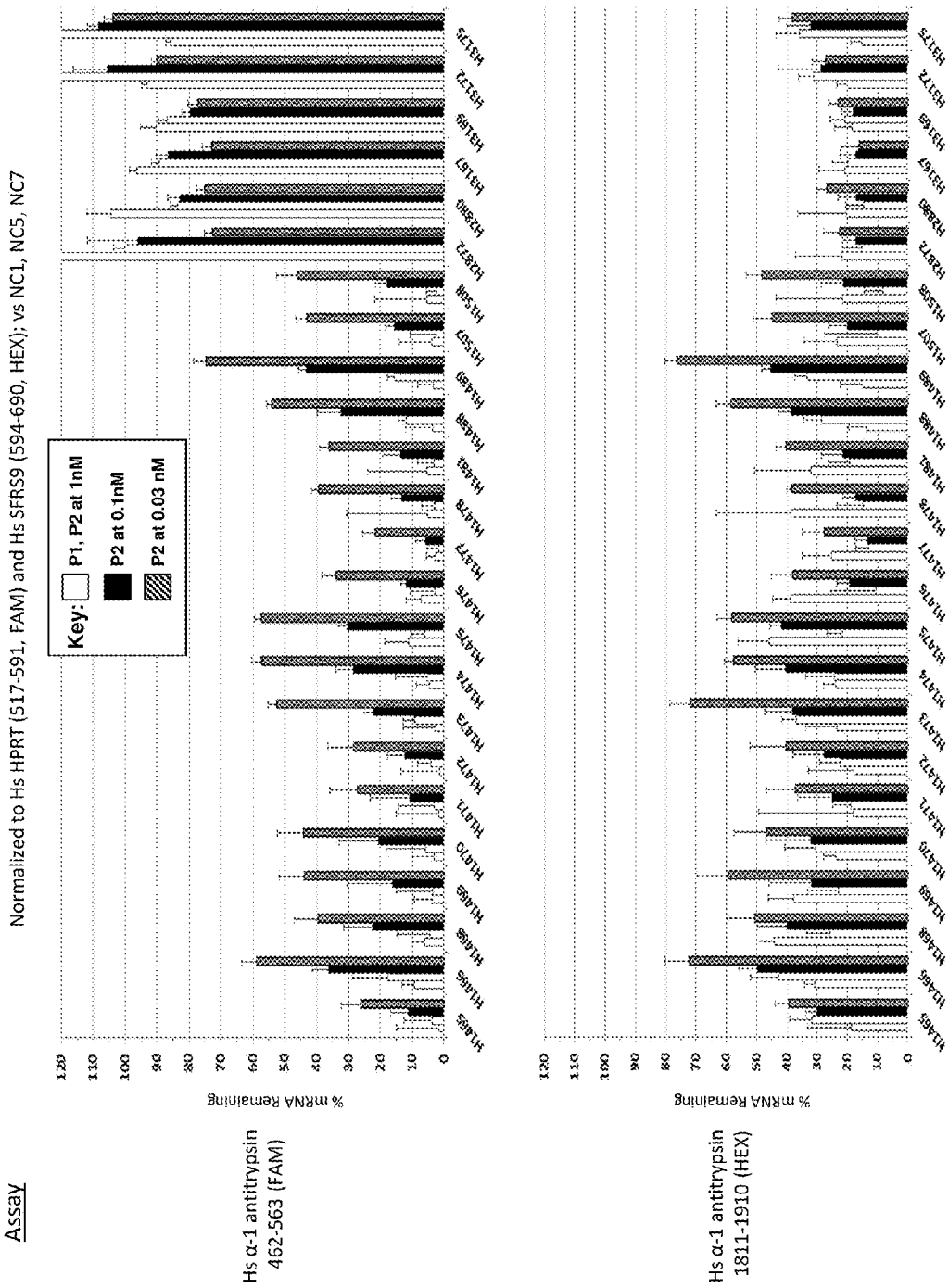

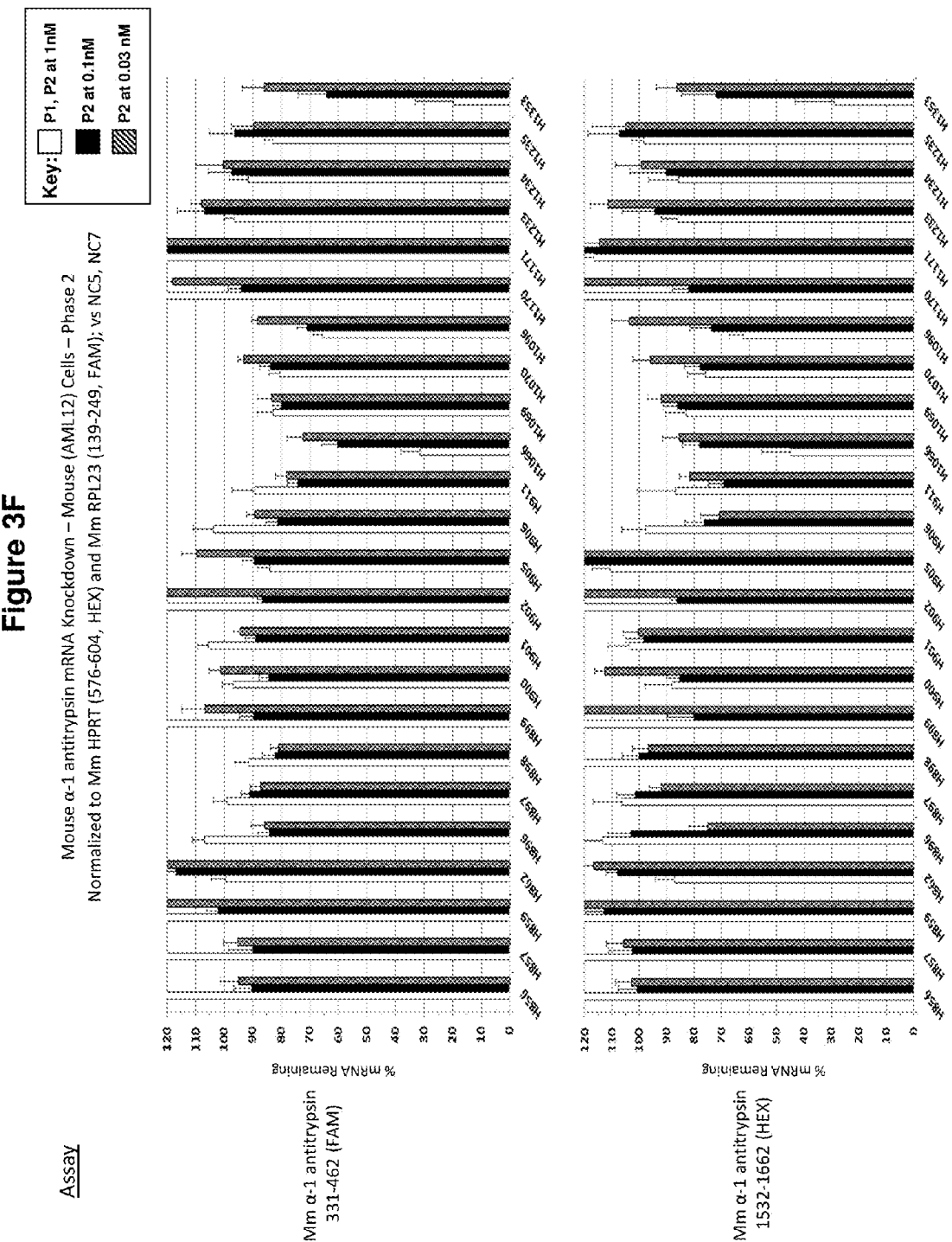

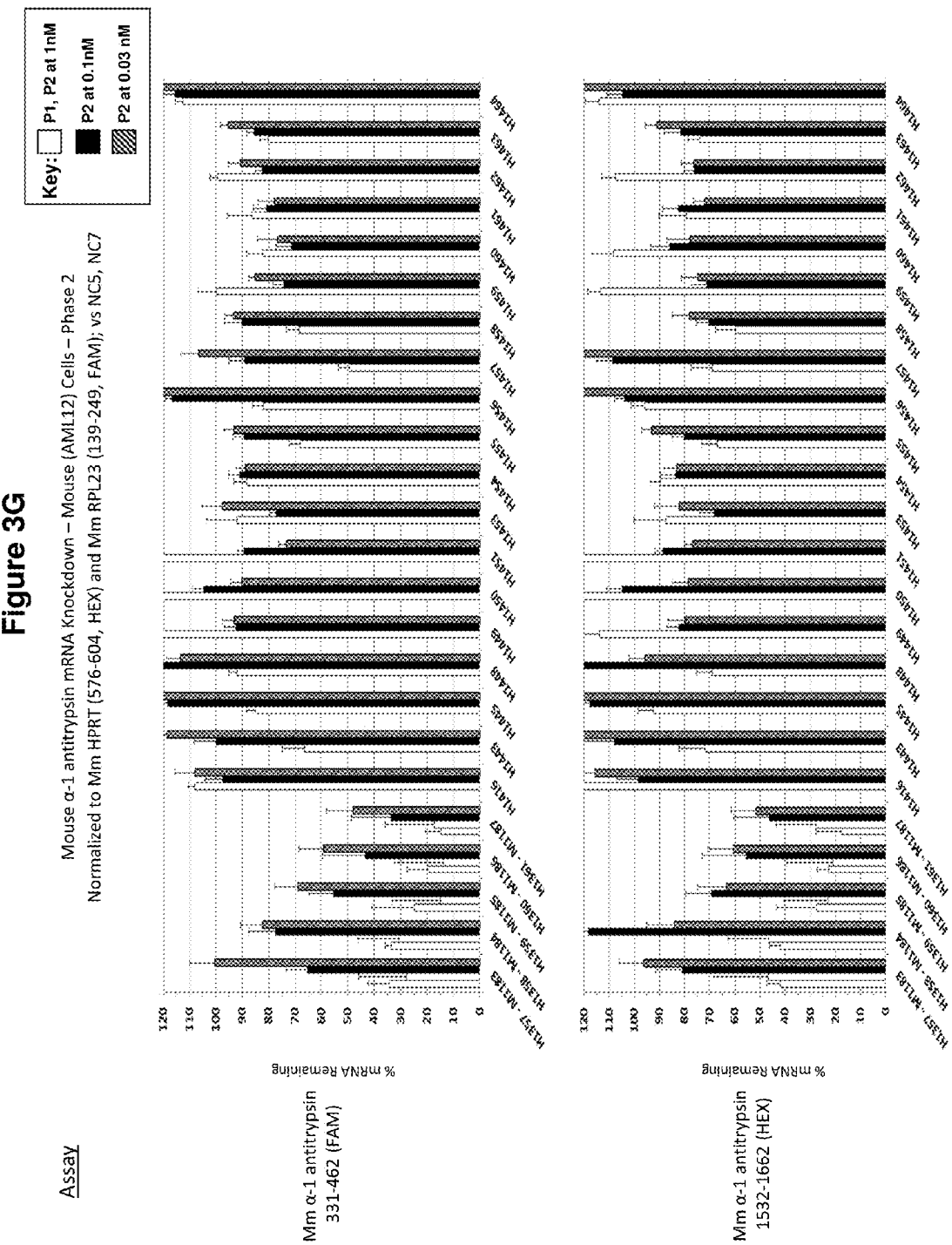

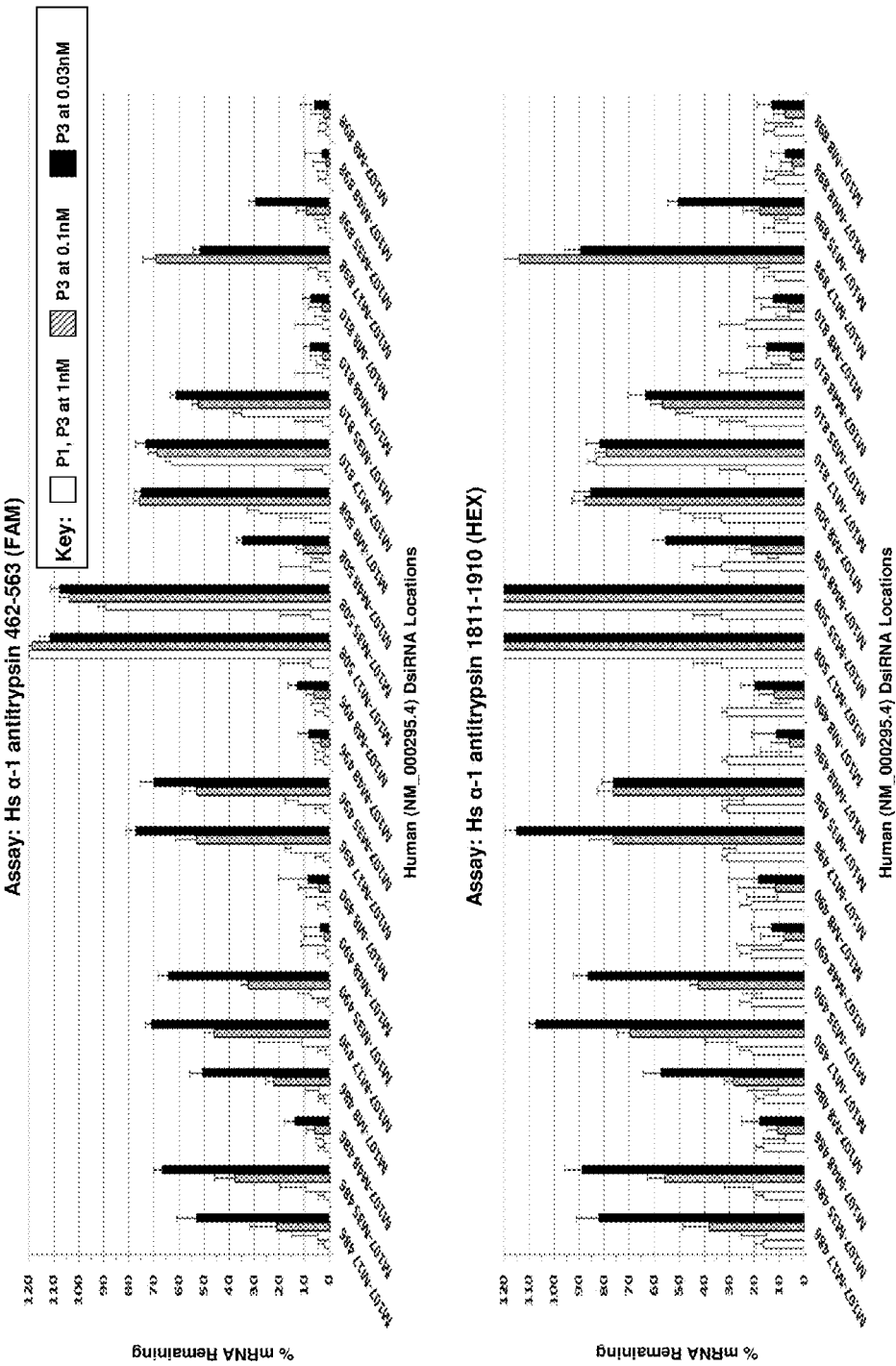

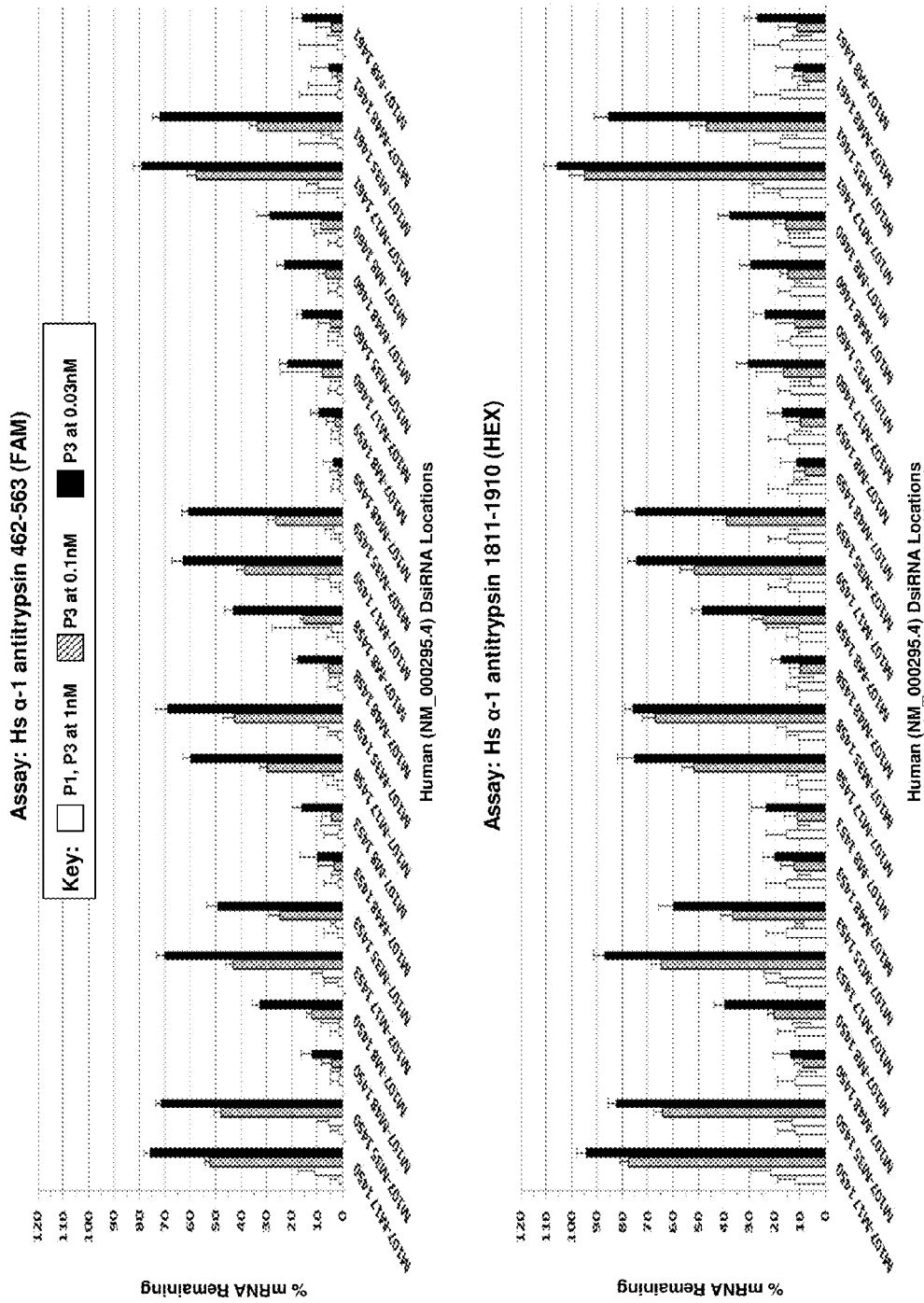

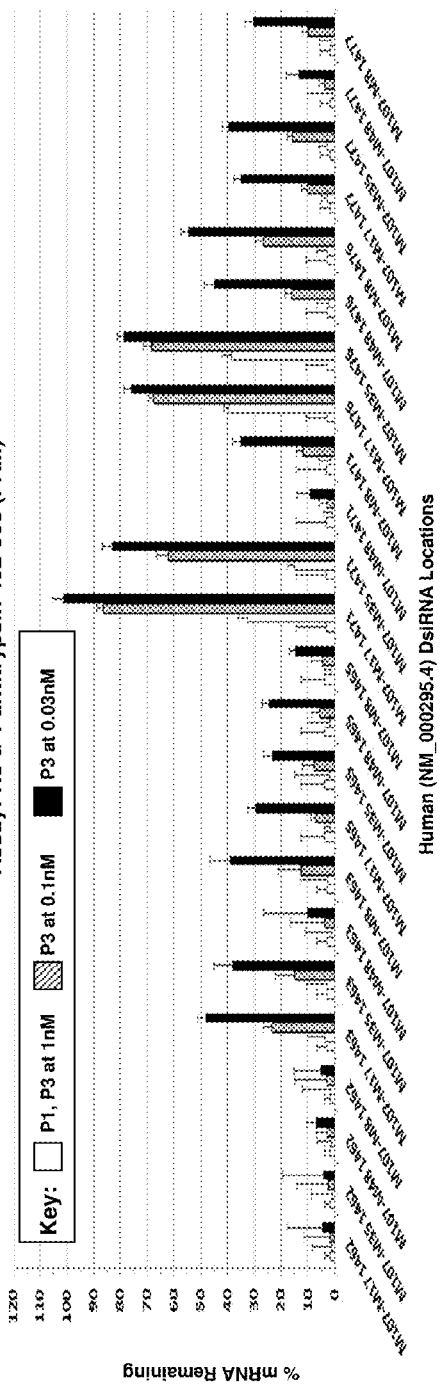

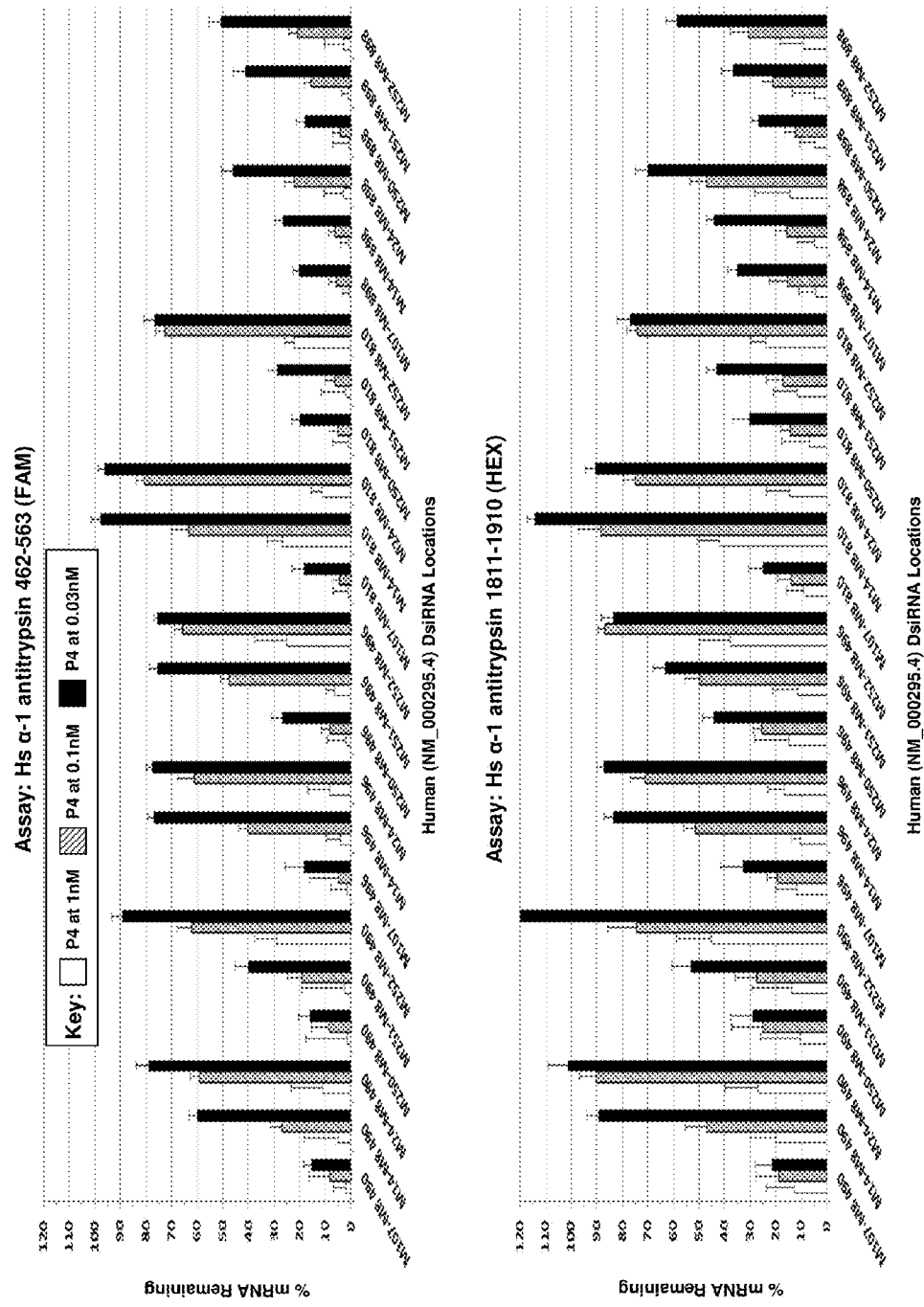

Figure 5F
Human α-1 antitrypsin Knockdown - Human (Huh7) Cells -- Phase 4 Screen
Normalized to Hs HPRT 517-591 (FAM) and Hs SFRS9 594-690 (HEX); vs NC1, NC5, NC7 Control
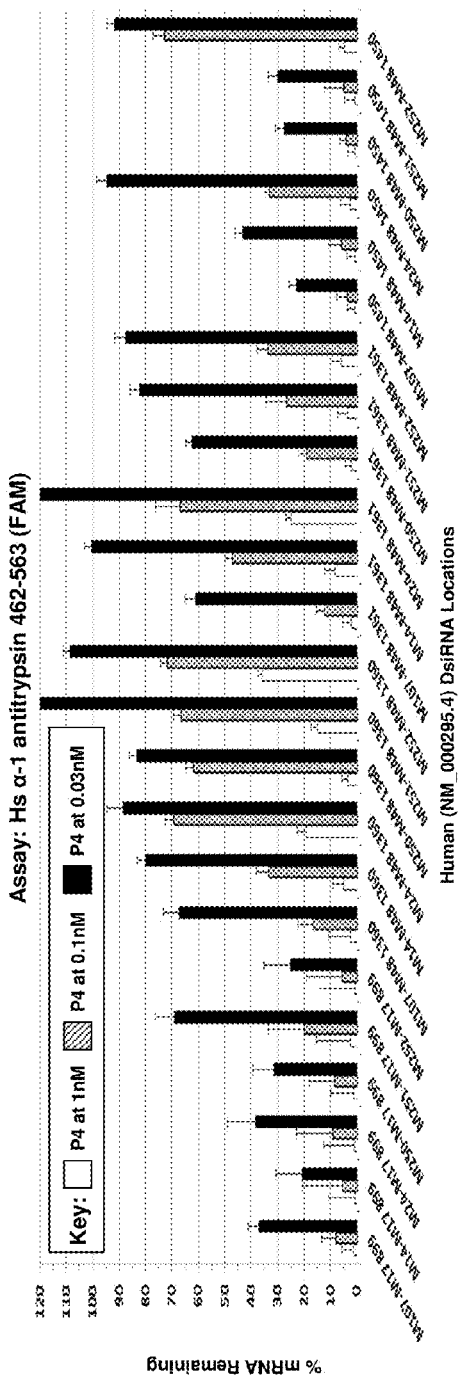
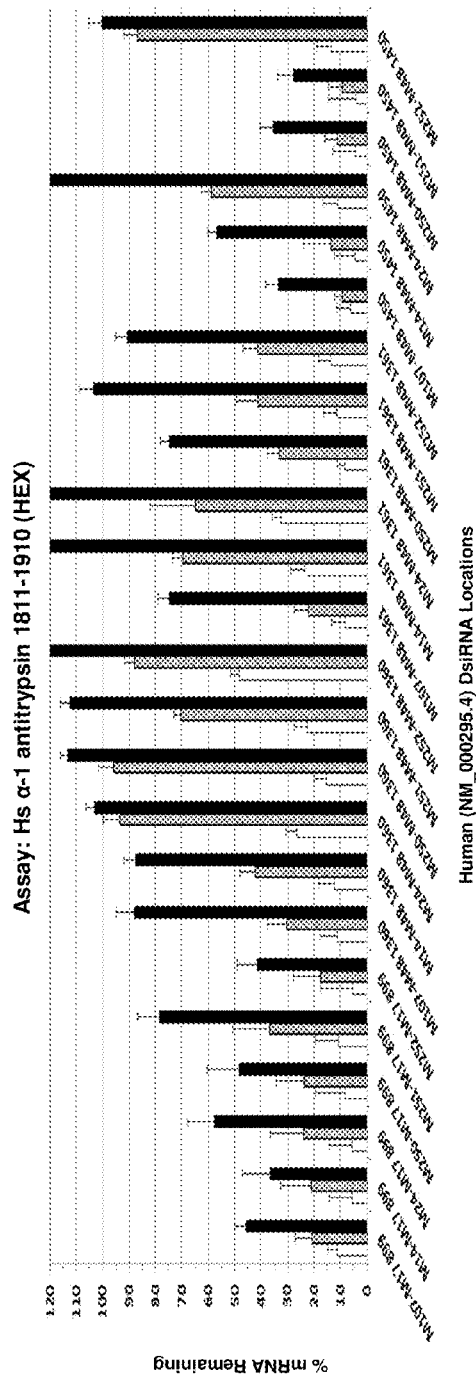

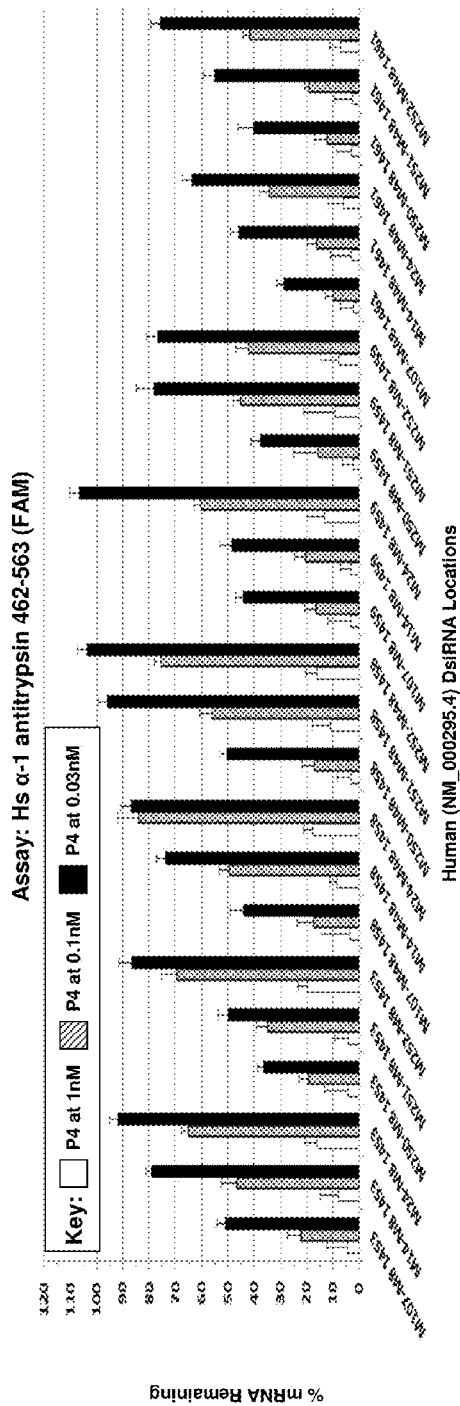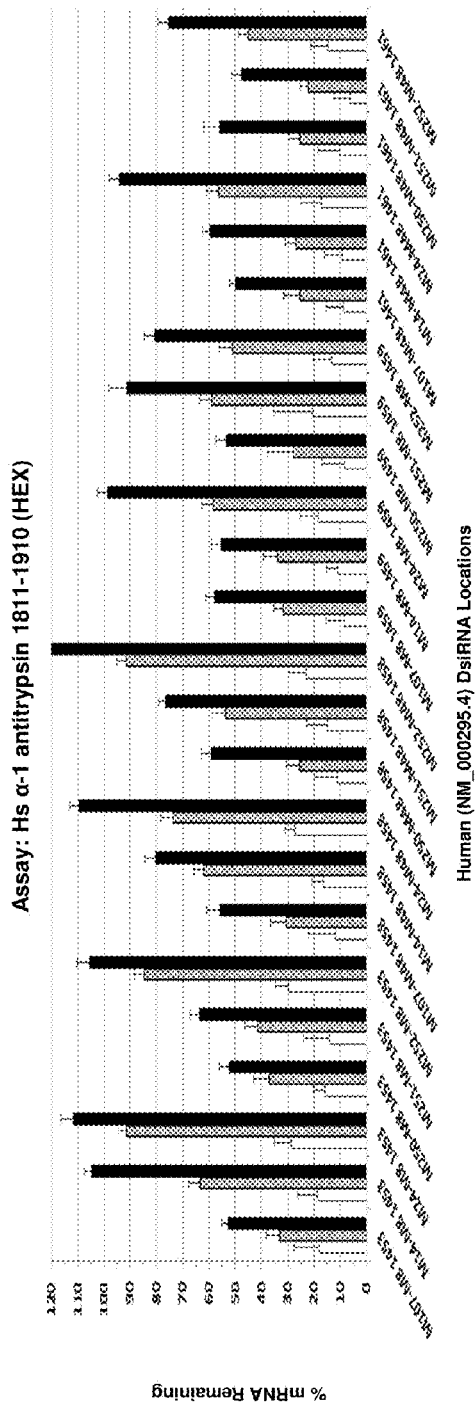
Figure 5G

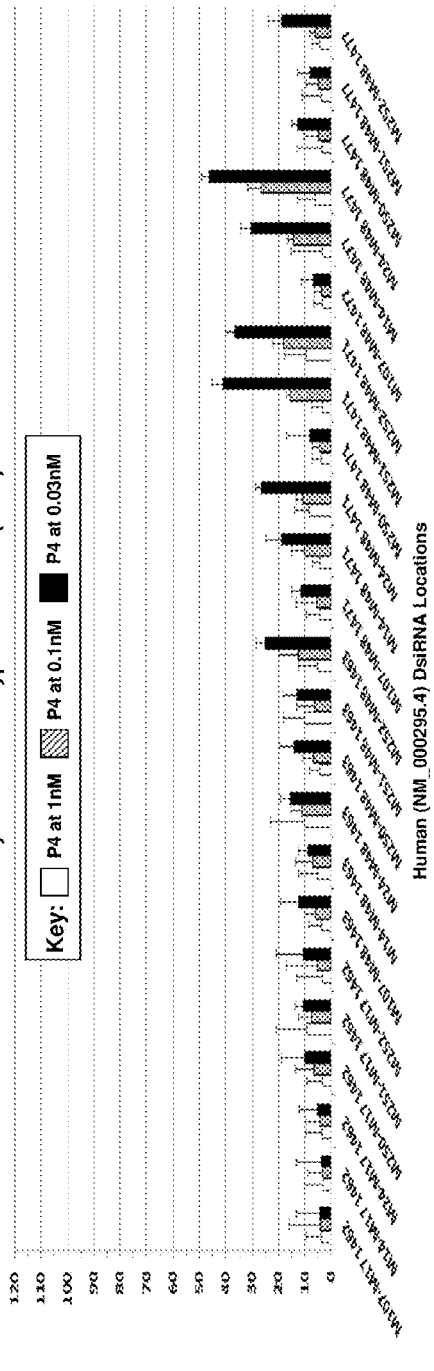

Figure 6A

METHODS AND COMPOSITIONS FOR THE SPECIFIC INHIBITION OF ALPHA-1 ANTITRYPSIN BY DOUBLE-STRANDED RNA

RELATED APPLICATIONS

The present application claims priority to, and the benefit under 35 U.S.C. §119(e) of the following applications: U.S. provisional patent application No. 61/842,551, entitled "Methods and Compositions for the Specific Inhibition of Alpha-1 Antitrypsin by Double-Stranded RNA," filed Jul. 3, 2013; and U.S. provisional patent application No. 61/891, 548, entitled "Methods and Compositions for the Specific Inhibition of Alpha-1 Antitrypsin by Double-Stranded RNA," filed Oct. 16, 2013. The entire contents of the aforementioned patent applications are incorporated herein by this reference.

FIELD OF THE INVENTION

The present invention relates to compounds, compositions, and methods for the study, diagnosis, and treatment of traits, diseases and conditions that respond to the modulation of α-1 antitrypsin gene expression and/or activity.

SEQUENCE SUBMISSION

The present application is being filed along with a Sequence Listing in electronic format. The Sequence Listing is entitled "301937_94007_seq_listing_1JUL2014", was created on Jul. 1, 2014, and is 692 kb in size. The information in the electronic format of the Sequence Listing is part of the present application and is incorporated herein by reference in its entirety.

BACKGROUND OF THE INVENTION

Alpha 1-antitrypsin (AAT or Serpina1) is a protease inhibitor belonging to the serpin superfamily. It is generally known as serum trypsin inhibitor. Alpha 1-antitrypsin is also referred to as alpha-1 proteinase inhibitor (A1PI) because it inhibits a wide variety of proteases (Gettins P G. Chem Rev 102: 4751-804). It protects tissues from enzymes of inflammatory cells, especially neutrophil elastase, and has a reference range in blood of 1.5-3.5 gram/liter, but multi-fold elevated levels can occur upon acute inflammation (Kushner, Mackiewicz. Acute-phase glycoproteins: molecular biology, biochemistry and clinical applications (CRC Press). pp. 3-19). In the absence of AAT, neutrophil elastase is free to break down elastin, which contributes to the elasticity of the lungs, resulting in respiratory complications such as emphysema, or COPD (chronic obstructive pulmonary disease) in adults and cirrhosis in adults or children. Individuals with mutations in one or both copies of the AAT gene can suffer from alpha-1 anti-trypsin deficiency, which presents as a risk of developing pulmonary emphysema or chronic liver disease due to greater than normal elastase activity in the lungs and liver.

In affected individuals, the deficiency in alpha-1 antitrypsin is a deficiency of wildtype, functional alpha-1 antitrypsin. However, in some cases that are relevant to the current invention, the individual is producing significant quantities of alpha-1 antitrypsin, but a proportion of the alpha-1 antitrypsin protein being produced is misfolded or contains mutations that compromise the functioning of the protein. In some cases, the individual is producing misfolded proteins which cannot be properly transported from the site of synthesis to the site of action within the body.

Liver disease resulting from alpha-1 antitrypsin deficiency can be caused by such misfolded proteins. Mutant forms of alpha-1 antitrypsin (e.g., the common PiZ variant, which harbors a glutamate to lysine mutation at position 342 (position 366 in pre-processed form)) are produced in liver cells (hepatocytes in the liver commonly produce a large amount of circulating AAT), and in the misfolded configuration, such forms are not readily transported out of the cells. This leads to a buildup of misfolded protein in the liver cells (hepatocytes, where those with the largest burden of mutant Z protein can suffer a cascade of intracellular damage that ultimately results in apoptosis; this chronic cycle of hepatocellular apoptosis and regeneration can lead to fibrosis and organ injury) and can cause one or more diseases or disorders of the liver including, but not limited to, chronic liver disease, liver inflammation, cirrhosis, liver fibrosis, and/or hepatocellular carcinoma.

There are currently few options for treating patients with liver disease associated with alpha-1 antitrypsin deficiency, and such options include hepatitis vaccination, supportive care, and avoidance of injurious agents (e.g., alcohol and NSAIDs), none of which provide a targeted therapy. Replacement of alpha-1 antitrypsin has no impact on liver disease in these patients but liver transplantation can be effective.

Double-stranded RNA (dsRNA) agents possessing strand lengths of 25 to 35 nucleotides have been described as effective inhibitors of target gene expression in mammalian cells (Rossi et al., U.S. Patent Application Nos. 2005/0244858 and US 2005/0277610). dsRNA agents of such length are believed to be processed by the Dicer enzyme of the RNA interference (RNAi) pathway, leading such agents to be termed "Dicer substrate siRNA" ("DsiRNA") agents. Additional modified structures of DsiRNA agents were previously described (Rossi et al., U.S. Patent Application No. 2007/0265220). Effective extended forms of Dicer substrates have also recently been described (Brown, U.S. Pat. No. 8,349,809 and US 2010/0173974).

Provided herein are improved nucleic acid agents that target α-1 antitrypsin. In particular, those targeting α-1 antitrypsin have been specifically exemplified.

BRIEF SUMMARY OF THE INVENTION

The present invention is directed to nucleic acid compositions that reduce expression of α-1 antitrypsin. Such compositions contain nucleic acids such as double stranded RNA ("dsRNA"), and methods for preparing them. The nucleic acids of the invention are capable of reducing the expression of a target α-1 antitrypsin gene in a cell, either in vitro or in a mammalian subject.

In one aspect, the invention provides a nucleic acid having an oligonucleotide strand of 15-35 nucleotides in length that is sufficiently complementary to a target α-1 antitrypsin mRNA sequence of SEQ ID NOs: 991-1188 along at least 15 nucleotides of the oligonucleotide strand length to reduce α-1 antitrypsin target mRNA expression when the nucleic acid is introduced into a mammalian cell.

In another aspect, the invention provides a nucleic acid having an oligonucleotide strand of 19-35 nucleotides in length that is sufficiently complementary to a target α-1 antitrypsin mRNA sequence of SEQ ID NOs: 991-1188 along at least 19 nucleotides of the oligonucleotide strand length to reduce α-1 antitrypsin target mRNA expression when the nucleic acid is introduced into a mammalian cell.

In a further aspect, the invention provides a double stranded nucleic acid (dsNA) having first and second nucleic acid strands that include RNA, where the first strand is 15-35 nucleotides in length and the second strand is 19-35 nucleotides in length and is sufficiently complementary to a target α-1 antitrypsin mRNA sequence of SEQ ID NOs: 991-1188 along at least 15 nucleotides of the second oligonucleotide strand length to reduce α-1 antitrypsin target mRNA expression when the dsNA is introduced into a mammalian cell.

In an additional aspect, the invention provides a dsNA having first and second nucleic acid strands, where the first strand is 15-35 nucleotides in length and the second strand of the dsNA is 19-35 nucleotides in length and is sufficiently complementary to a target α-1 antitrypsin mRNA sequence of SEQ ID NOs: 991-1188 along at least 19 nucleotides of the second oligonucleotide strand length to reduce α-1 antitrypsin target mRNA expression when the dsNA is introduced into a mammalian cell.

In another aspect, the invention provides a dsNA having first and second nucleic acid strands, where the first strand is 15-35 nucleotides in length and the second strand of the dsNA is 19-35 nucleotides in length and is sufficiently complementary to a target α-1 antitrypsin mRNA sequence of SEQ ID NOs: 991-1188 along at least 19 nucleotides of the second oligonucleotide strand length to reduce α-1 antitrypsin target mRNA expression, and where, starting from the 5' end of the α-1 antitrypsin mRNA sequence of SEQ ID NOs: 991-1188 (referred to as position 1), mammalian Ago2 cleaves the mRNA at a site between positions 9 and 10 of the sequence when the dsNA is introduced into a mammalian cell.

In a further aspect, the invention provides a dsNA molecule that consists of (a) a sense region and an antisense region, where the sense region and the antisense region together form a duplex region consisting of 25-35 base pairs and the antisense region comprises a sequence that is the complement of a sequence of any one (or more) of SEQ ID NOs: 991-1188 and 1938-1968; and (b) from zero to two 3' overhang regions, where each overhang region is six or fewer nucleotides in length, and where, starting from the 5' end of the α-1 antitrypsin mRNA sequence of SEQ ID NOs: 991-1188 and 1938-1968 (position 1), mammalian Ago2 cleaves the mRNA at a site between positions 9 and 10 of the sequence when the dsNA is introduced into a mammalian cell.

In an additional aspect, the invention provides a dsNA having first and second nucleic acid strands and a duplex region of at least 25 base pairs, where the first strand is 25-34 nucleotides in length and the second strand of the dsNA is 26-35 nucleotides in length and includes 1-5 single-stranded nucleotides at its 3' terminus, where the second oligonucleotide strand is sufficiently complementary to a target α-1 antitrypsin mRNA sequence of SEQ ID NOs: 991-1188 and 1938-1968 along at least 19 nucleotides of the second oligonucleotide strand length to reduce α-1 antitrypsin target gene expression when the dsNA is introduced into a mammalian cell.

In another aspect, the invention provides a dsNA having first and second nucleic acid strands and a duplex region of at least 25 base pairs, where the first strand is 25-34 nucleotides in length and the second strand of the dsNA is 26-35 nucleotides in length and comprises 1-5 single-stranded nucleotides at its 3' terminus, where the 3' terminus of the first oligonucleotide strand and the 5' terminus of the second oligonucleotide strand form a blunt end, and the second oligonucleotide strand is sufficiently complementary to a target α-1 antitrypsin sequence of SEQ ID NOs: 991-1188 and 1938-1968 along at least 19 nucleotides of the second oligonucleotide strand length to reduce α-1 antitrypsin mRNA expression when the dsNA is introduced into a mammalian cell.

In an additional aspect, the invention provides a nucleic acid possessing an oligonucleotide strand of 15-35 nucleotides in length, where the oligonucleotide strand is hybridizable to a target α-1 antitrypsin mRNA sequence of SEQ ID NOs: 991-1188 or 1938-1968 along at least 15 nucleotides of the oligonucleotide strand length.

Another aspect of the invention provides a dsNA having first and second nucleic acid strands that include RNA, where the first strand is 15-35 nucleotides in length and the second strand of the dsNA is 19-35 nucleotides in length, where the second oligonucleotide strand is hybridizable to a target α-1 antitrypsin mRNA sequence of SEQ ID NOs: 991-1188 or 1938-1968 along at least 15 nucleotides of the second oligonucleotide strand length.

A further aspect of the invention provides an in vivo hybridization complex within a cell that includes an exogenous nucleic acid sequence and a target alpha-1 antitrypsin mRNA sequence of SEQ ID NOs: 991-1188 or 1938-1968.

An additional aspect of the invention provides an in vitro hybridization complex within a cell that includes an exogenous nucleic acid sequence and a target alpha-1 antitrypsin mRNA sequence of SEQ ID NOs: 991-1188 or 1938-1968.

In one embodiment, the dsNA has a duplex region that is 19-21 base pairs, 21-25 base pairs or at least 25 base pairs in length.

In another embodiment, the second oligonucleotide strand includes 1-5 single-stranded nucleotides at its 3' terminus.

In an additional embodiment, the first strand is 25-35 nucleotides in length. Optionally, the second strand is 25-35 nucleotides in length.

In another embodiment, the second oligonucleotide strand is complementary to target α-1 antitrypsin cDNA sequence GenBank Accession No. NM_000295.4 along at most 27 nucleotides of the second oligonucleotide strand length.

In one embodiment, the dsNA or hybridization complex comprises a modified nucleotide. Optionally, the modified nucleotide residue is of the group consisting of 2'-O-methyl, 2'-methoxyethoxy, 2'-fluoro, 2'-allyl, 2'-O—[2-(methylamino)-2-oxoethyl], 4'-thio, 4'-CH2-O-2'-bridge, 4'-(CH2) 2-O-2'-bridge, 2'-LNA, 2'-amino and 2'-O—(N-methylcarbamate).

In a further embodiment, starting from the first nucleotide (position 1) at the 3' terminus of the first oligonucleotide strand, position 1, 2 or 3 is substituted with a modified nucleotide. Optionally, the modified nucleotide residue of the 3' terminus of the first strand is a deoxyribonucleotide, an acyclonucleotide or a fluorescent molecule. In certain embodiments, position 1 of the 3' terminus of the first oligonucleotide strand is a deoxyribonucleotide.

In one embodiment, the first strand is 25 nucleotides in length and the second strand is 27 nucleotides in length. Optionally, the 3' terminus of the first strand and the 5' terminus of the second strand form a blunt end.

In another embodiment, starting from the 5' end of a α-1 antitrypsin mRNA sequence of SEQ ID NOs: 991-1188 and 1938-1968 (position 1), mammalian Ago2 cleaves the mRNA at a site between positions 9 and 10 of the sequence, thereby reducing α-1 antitrypsin target mRNA expression when the dsNA is introduced into a mammalian cell. Optionally, the second strand includes a sequence of SEQ ID NOs: 199-396 or 3493-3499. In certain embodiments, the first strand includes a sequence of SEQ ID NOs: 1-198.

In one embodiment, the dsNA includes a pair of first strand/second strand sequences of Table 2.

In a further embodiment, each of the first and the second strands has a length which is at least 26 nucleotides.

In one embodiment, nucleotides of the 1-5 single-stranded nucleotides of the 3' terminus of the second strand include a modified nucleotide. Optionally, the modified nucleotide is a 2'-O-methyl ribonucleotide. In a related embodiment, all nucleotides of the 1-5 single-stranded nucleotides of the 3' terminus of the second strand are modified nucleotides. In certain embodiments, the 1-5 single-stranded nucleotides of the 3' terminus of the second strand are 1-4 nucleotides in length, are 1-3 nucleotides in length, or are 1-2 nucleotides in length. In a related embodiment, the 1-5 single-stranded nucleotides of the 3' terminus of the second strand is two nucleotides in length and includes a 2'-O-methyl modified ribonucleotide.

In certain embodiments, the second oligonucleotide strand includes a modification pattern of AS-M1 to AS-M84, AS-M88 to AS-M96, AS-M210, AS-M1* to AS-M84*, AS-M88* to AS-M96* or AS-M210*.

Optionally, the first oligonucleotide strand includes a modification pattern of SM1 to SM119 or SM250 to SM252.

In a further embodiment, each of the first and the second strands has a length which is at least 26 and at most 30 nucleotides.

Optionally, the dsNA is cleaved endogenously in the cell by Dicer.

In certain embodiments, a dsNA of the invention includes at least one unlocked nucleobase analog (UNA). Optionally, the at least one UNA is located in a 3'-overhang region, a 5'-overhang region, or both such regions of the dsNA, optionally on the guide strand of the dsNA.

In some embodiments, a dsNA of the invention is attached to a dynamic polyconjugate (DPC). In additional embodiments, a dsNA of the invention is administered with a DPC, where optionally the dsNA and DPC are not attached.

In some embodiments, a dsNA of the invention is attached to a GalNAc moiety (optionally, a tri-antennary GalNAc moiety) and/or to cholesterol or a cholesterol targeting ligand.

In certain embodiments, the amount of the nucleic acid sufficient to reduce expression of the target gene is 1 nanomolar or less, 200 picomolar or less, 100 picomolar or less, 50 picomolar or less, 20 picomolar or less, 10 picomolar or less, 5 picomolar or less, 2, picomolar or less or 1 picomolar or less in the environment of the cell.

In one embodiment, the dsNA possesses greater potency than a 21mer siRNA directed to the identical at least 19 nucleotides of the target α-1 antitrypsin mRNA in reducing target α-1 antitrypsin mRNA expression when assayed in vitro in a mammalian cell at an effective concentration in the environment of a cell of 1 nanomolar or less. In certain embodiments, knockdown efficacy and/or potency is measured at a concentration of 1 nanomolar, 200 picomolar, 100 picomolar, 50 picomolar, 20 picomolar, 10 picomolar, 5 picomolar, 2, picomolar or 1 picomolar in the environment of a cell.

In another embodiment, the dsNA is sufficiently complementary to the target α-1 antitrypsin mRNA sequence to reduce α-1 antitrypsin target mRNA expression by an amount (expressed by %) that is at least 10%, at least 50%, at least 80-90%, at least 95%, at least 98%, or at least 99% when the dsNA is introduced into a mammalian cell.

In certain embodiments, the first and second strands are joined by a chemical linker. Optionally, the 3' terminus of the first strand and the 5' terminus of the second strand are joined by a chemical linker.

In one embodiment, a nucleotide of the second or first strand is substituted with a modified nucleotide that directs the orientation of Dicer cleavage.

Optionally, the dsNA includes a deoxyribonucleotide, a dideoxyribonucleotide, an acyclonucleotide, a 3'-deoxyadenosine (cordycepin), a 3'-azido-3'-deoxythymidine (AZT), a 2',3'-dideoxyinosine (ddI), a 2',3'-dideoxy-3'-thiacytidine (3TC), a 2',3'-didehydro-2',3'-dideoxythymidine (d4T), a monophosphate nucleotide of 3'-azido-3'-deoxythymidine (AZT), a 2',3'-dideoxy-3'-thiacytidine (3TC) and a monophosphate nucleotide of 2',3'-didehydro-2',3'-dideoxythymidine (d4T), a 4-thiouracil, a 5-bromouracil, a 5-iodouracil, a 5-(3-aminoallyl)-uracil, a 2'-O-alkyl ribonucleotide, a 2'-O-methyl ribonucleotide, a 2'-amino ribonucleotide, a 2'-fluoro ribonucleotide, or a locked nucleic acid.

In certain embodiments, the dsNA includes a phosphate backbone modification that is a phosphonate, a phosphorothioate or a phosphotriester.

In one embodiment, the dsNA includes a morpholino nucleic acid or a peptide nucleic acid (PNA).

In one aspect, the invention provides a method for reducing expression of a target α-1 antitrypsin gene in a mammalian cell involving contacting a mammalian cell in vitro with a dsNA of the invention in an amount sufficient to reduce expression of a target α-1 antitrypsin mRNA in the cell.

In one embodiment, target α-1 antitrypsin mRNA expression is reduced by at least 10%, at least 50% or at least 80-90%. Optionally, α-1 antitrypsin mRNA levels are reduced by at least 90% at least 8 days after the cell is contacted with the dsNA. In certain embodiments, α-1 antitrypsin mRNA levels are reduced by at least 70% at least 10 days after the cell is contacted with the dsNA.

In one aspect, the invention provides a method for reducing expression of a target α-1 antitrypsin mRNA in a mammal involving administering a nucleic acid of the invention to a mammal in an amount sufficient to reduce expression of a target α-1 antitrypsin mRNA in the mammal.

In certain embodiments, the nucleic acid is formulated in a lipid nanoparticle (LNP). In one embodiment, the nucleic acid is administered at a dosage that is 1 microgram to 5 milligrams per kilogram of the mammal per day, 100 micrograms to 0.5 milligrams per kilogram, 0.001 to 0.25 milligrams per kilogram, 0.01 to 20 micrograms per kilogram, 0.01 to 10 micrograms per kilogram, 0.10 to 5 micrograms per kilogram, or 0.1 to 2.5 micrograms per kilogram.

In certain embodiments, the nucleic acid possesses greater potency than 21mer siRNAs directed to the identical at least 19 nucleotides of the target α-1 antitrypsin mRNA in reducing target α-1 antitrypsin mRNA expression when assayed in vitro in a mammalian cell at an effective concentration in the environment of a cell of 1 nanomolar or less. In certain embodiments, knockdown efficacy and/or potency is measured at a concentration of 1 nanomolar, 200 picomolar, 100 picomolar, 50 picomolar, 20 picomolar, 10 picomolar, 5 picomolar, 2, picomolar or 1 picomolar in the environment of a cell.

In another embodiment, α-1 antitrypsin mRNA levels are reduced in a tissue of the mammal by at least 70% at least 3 days after the dsNA is administered to the mammal. Optionally, the tissue is liver tissue.

In certain embodiments, administering includes intravenous injection, intramuscular injection, intraperitoneal injection, infusion, subcutaneous injection, transdermal, aerosol, rectal, vaginal, topical, oral or inhaled delivery.

In another aspect, the invention provides a method for treating or preventing a liver disease or disorder in a subject that involves administering a dsNA of the invention to the subject in an amount sufficient to treat or prevent the liver disease or disorder in the subject.

In one embodiment, the liver disease or disorder is a chronic liver disease, liver inflammation, cirrhosis, liver fibrosis or hepatocellular carcinoma. Optionally, the subject is human.

In a further aspect, the invention provides a formulation containing a nucleic acid of the invention present in an amount effective to reduce target α-1 antitrypsin mRNA levels when the nucleic acid is introduced into a mammalian cell in vitro by at least 10%, at least 50% or at least 80-90%.

In one embodiment, the effective amount is 1 nanomolar or less, 200 picomolar or less, 100 picomolar or less, 50 picomolar or less, 20 picomolar or less, 10 picomolar or less, 5 picomolar or less, 2, picomolar or less or 1 picomolar or less in the environment of the cell. In certain embodiments, knockdown efficacy is measured at a concentration of 1 nanomolar, 200 picomolar, 100 picomolar, 50 picomolar, 20 picomolar, 10 picomolar, 5 picomolar, 2, picomolar or 1 picomolar in the environment of a cell.

In another aspect, the invention provides a formulation including the dsNA of the invention present in an amount effective to reduce target α-1 antitrypsin mRNA levels when the dsNA is introduced into a cell of a mammalian subject by at least 10%, at least 50% or at least 80-90%. Optionally, the effective amount is a dosage of 1 microgram to 5 milligrams per kilogram of the subject per day, 100 micrograms to 0.5 milligrams per kilogram, 0.001 to 0.25 milligrams per kilogram, 0.01 to 20 micrograms per kilogram, 0.01 to 10 micrograms per kilogram, 0.10 to 5 micrograms per kilogram, or 0.1 to 2.5 micrograms per kilogram.

In an additional aspect, the invention provides a mammalian cell containing a nucleic acid of the invention.

In a further aspect, the invention provides a pharmaceutical composition containing a nucleic acid of the invention and a pharmaceutically acceptable carrier.

In another aspect, the invention provides a kit that includes a nucleic acid of the invention and instructions for its use.

In an additional aspect, the invention provides a composition possessing α-1 antitrypsin inhibitory activity that consists essentially of a nucleic acid of the invention.

Another aspect of the invention provides a method of hybridizing an exogenous nucleic acid to mRNA in a cell that involves introducing into the cell an exogenous nucleic acid sequence and hybridizing the exogenous nucleic acid to a target alpha-1 antitrypsin mRNA sequence that is a sequence of SEQ ID NOs: 991-1188 or 1938-1968.

A further aspect of the invention provides a method of treating an individual with a liver or lung disease or disorder that involves introducing into cells of the individual an exogenous nucleic acid sequence and hybridizing the exogenous nucleic acid to a target alpha-1 antitrypsin mRNA sequence of SEQ ID NOs: 991-1188 or 1938-1968.

An additional aspect of the invention provides a method of forming an in vivo hybridization complex within a cell that involves introducing into the cell an exogenous nucleic acid sequence and hybridizing the exogenous nucleic acid to a target alpha-1 antitrypsin mRNA sequence of SEQ ID NOs: 991-1188 or 1938-1968.

A further aspect of the invention provides a method of inhibiting translation of a target mRNA into a protein within a cell that involves introducing into the cell an exogenous nucleic acid sequence and hybridizing the exogenous nucleic acid to a target alpha-1 antitrypsin mRNA sequence of SEQ ID NOs: 991-1188 or 1938-1968, complexing the exogenous nucleic acid with RISC, and cleaving the mRNA.

In one embodiment, the exogenous nucleic acid is complexed with RISC. In a related embodiment, the RISC cleaves the mRNA.

Another aspect of the invention provides a "single strand-extended" (here, guide strand-extended, at the 5' end) dsNA. Specifically, this aspect of the invention provides a dsNA having first and second nucleic acid strands that include RNA, where the first strand is 15-35 nucleotides in length and the second strand is at least 35 nucleotides in length, optionally includes a second strand sequence having at least 25 nucleotides of a sequence of SEQ ID NOs: 3493-3499 and is sufficiently complementary to a target α-1 antitrypsin mRNA sequence of SEQ ID NOs: 991-1188 along at least 15 nucleotides of the second oligonucleotide strand length to reduce α-1 antitrypsin target mRNA expression when the dsNA is introduced into a mammalian cell.

BRIEF DESCRIPTION OF THE DRAWINGS

FIG. 1 shows the structures of exemplary DsiRNA agents of the invention targeting a site in the α-1 antitrypsin RNA referred to herein as the "α-1 antitrypsin-506" target site. UPPER case=unmodified RNA, lower case=DNA, Bold=mismatch base pair nucleotides; arrowheads indicate projected Dicer enzyme cleavage sites; dashed line indicates sense strand (top strand) sequences corresponding to the projected Argonaute 2 (Ago2) cleavage site within the targeted α-1 antitrypsin sequence.

FIGS. 2A to 2D present primary screen data showing DsiRNA-mediated knockdown of human α-1 antitrypsin (FIGS. 2A and 2B) and mouse α-1 antitrypsin (FIGS. 2C and 2D) in human (Huh7) and mouse (AML12) cells, respectively. For each DsiRNA tested, two independent qPCR amplicons were assayed (in human cells, amplicons "462-563" and "1811-1910" were assayed, while in mouse cells, amplicons "331-462" and "1532-1662" were assayed).

FIGS. 3A to 3H show histograms of human and mouse α-1 antitrypsin inhibitory efficacies observed for indicated DsiRNAs. "P1" indicates phase 1 (primary screen), while "P2" indicates phase 2. In phase 1, DsiRNAs were tested at 1 nM in the environment of Huh7 cells (human cell assays; FIGS. 3A to 3D) or mouse cells (AML12 cell assays; FIGS. 3E to 3H). In phase 2, DsiRNAs were tested at 1 nM, 0.1 nM and 0.03 nM in the environment of Huh7 cells. Individual bars represent average human (FIGS. 3A to 3D) or mouse (FIGS. 3E to 3H) α-1 antitrypsin levels observed in triplicate, with standard errors shown. Human α-1 antitrypsin levels were normalized to HPRT and SFRS9 levels, while mouse α-1 antitrypsin levels were normalized to HPRT and Rp123 levels.

FIGS. 4A to 4F present data showing levels of α-1 antitrypsin knockdown observed for 24α-1 antitrypsin-targeting duplex sequences possessing a range of guide strand 2'-O-methyl modifications and a single passenger strand 2'-O-methyl modification pattern, as depicted in FIGS. 4A and 4B. Bar graphs of FIGS. 4C to 4F show efficacy data for the 24 independent α-1 antitrypsin-targeting DsiRNAs across different, indicated guide (antisense) strand 2'-O-methyl modification patterns in human Huh7 cells at 0.03 nM, 0.1 nM and at 1 nM.

FIGS. 5A to 5H present data obtained in an expanded modified duplex screen. FIGS. 5A to 5D depict 2'-O-methyl modification patterns of both passenger and guide strands of tested duplexes (with FIG. 5D showing modification patterns of individual strands), while FIGS. 5E to 5H show histograms of human α-1 antitrypsin inhibitory efficacies observed for indicated DsiRNAs in human cells. "P4" indicates phase 4 (expanded modified duplex screen). In the expanded modification screen, DsiRNAs were tested at 0.03 nM, 0.1 nM and at 1 nM in the environment of human Huh7 cells. Individual bars represent average human α-1 antitrypsin levels observed in triplicate, with standard errors shown. Human α-1 antitrypsin levels were normalized to HPRT and SFRS9 levels.

FIGS. 6A and 6B demonstrate the robust α-1 antitrypsin knockdown efficacy of guide strand "extended" forms of α-1 antitrypsin-targeting DsiRNAs of the invention. FIG. 6A shows the specific sequences of each of the eight extended DsiRNAs tested (corresponding SEQ ID NOs are indicated at right for sense and antisense sequences, respectively). FIG. 6B shows $IC_{50}$ curves obtained for each of the eight guide strand "extended" forms of α-1 antitrypsin-targeting DsiRNAs that were tested ("C121" represents a control DsiRNA that does not target α-1 antitrypsin).

DETAILED DESCRIPTION OF THE INVENTION

Figure 2D:
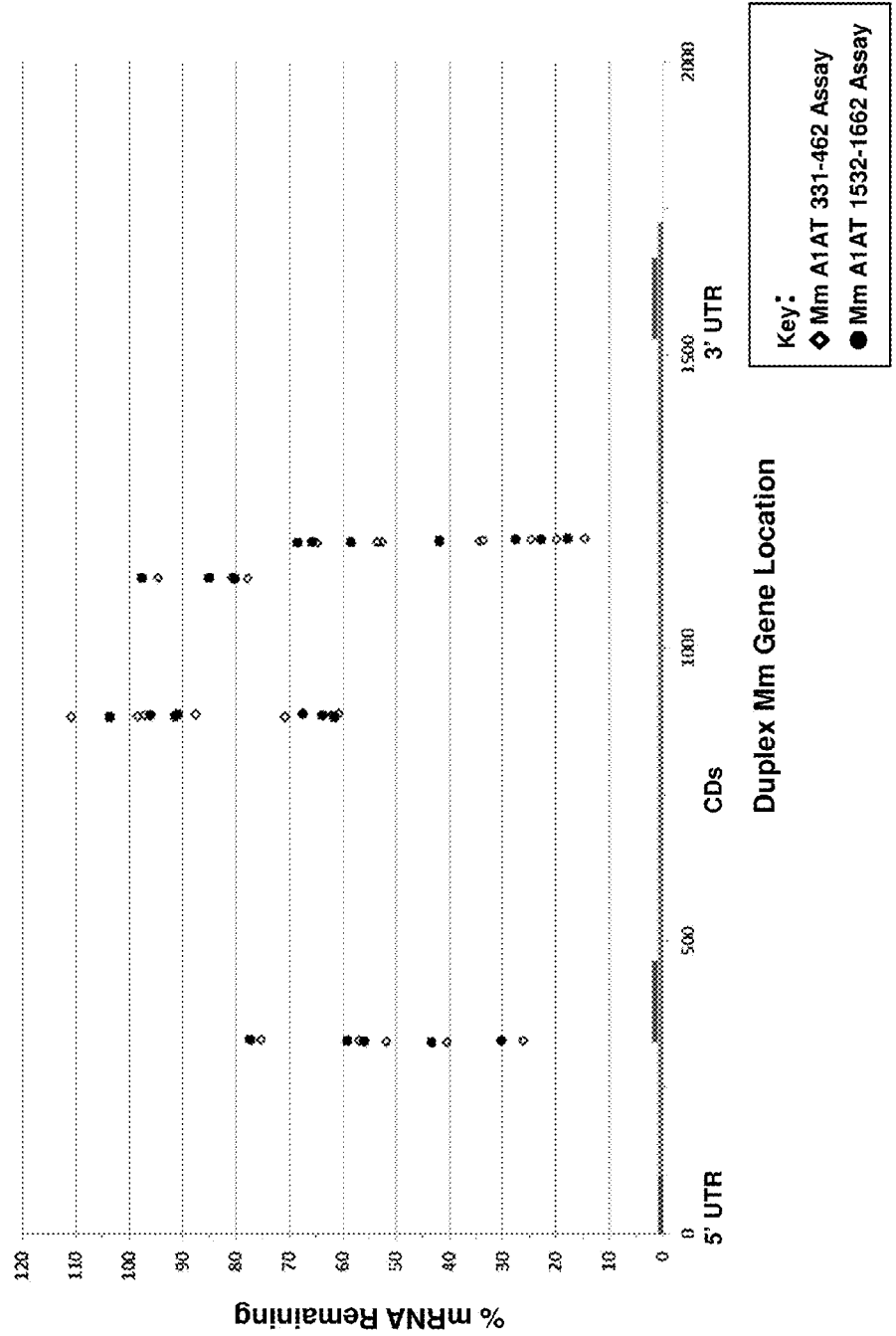
Figure 3E:
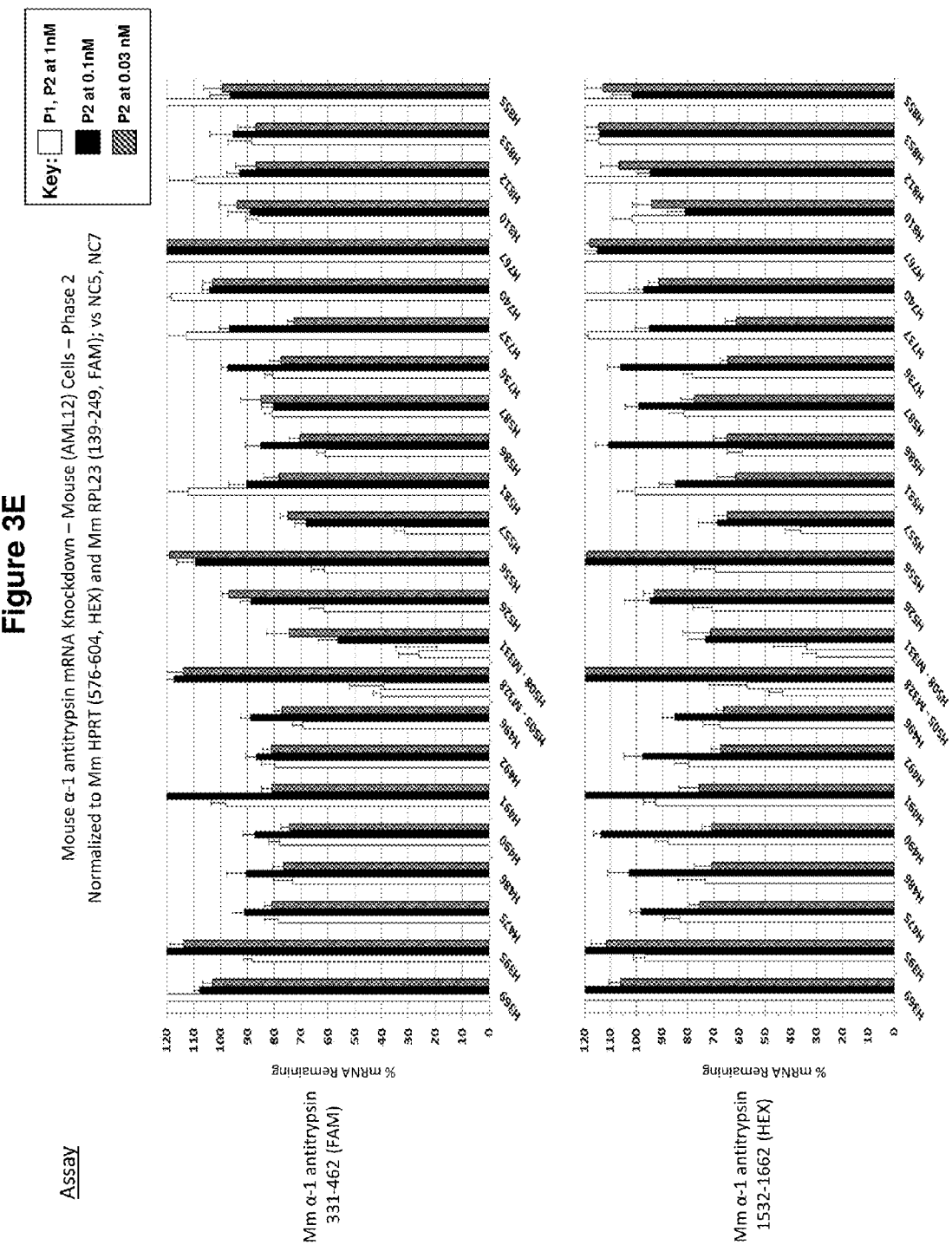
Figure 3H:
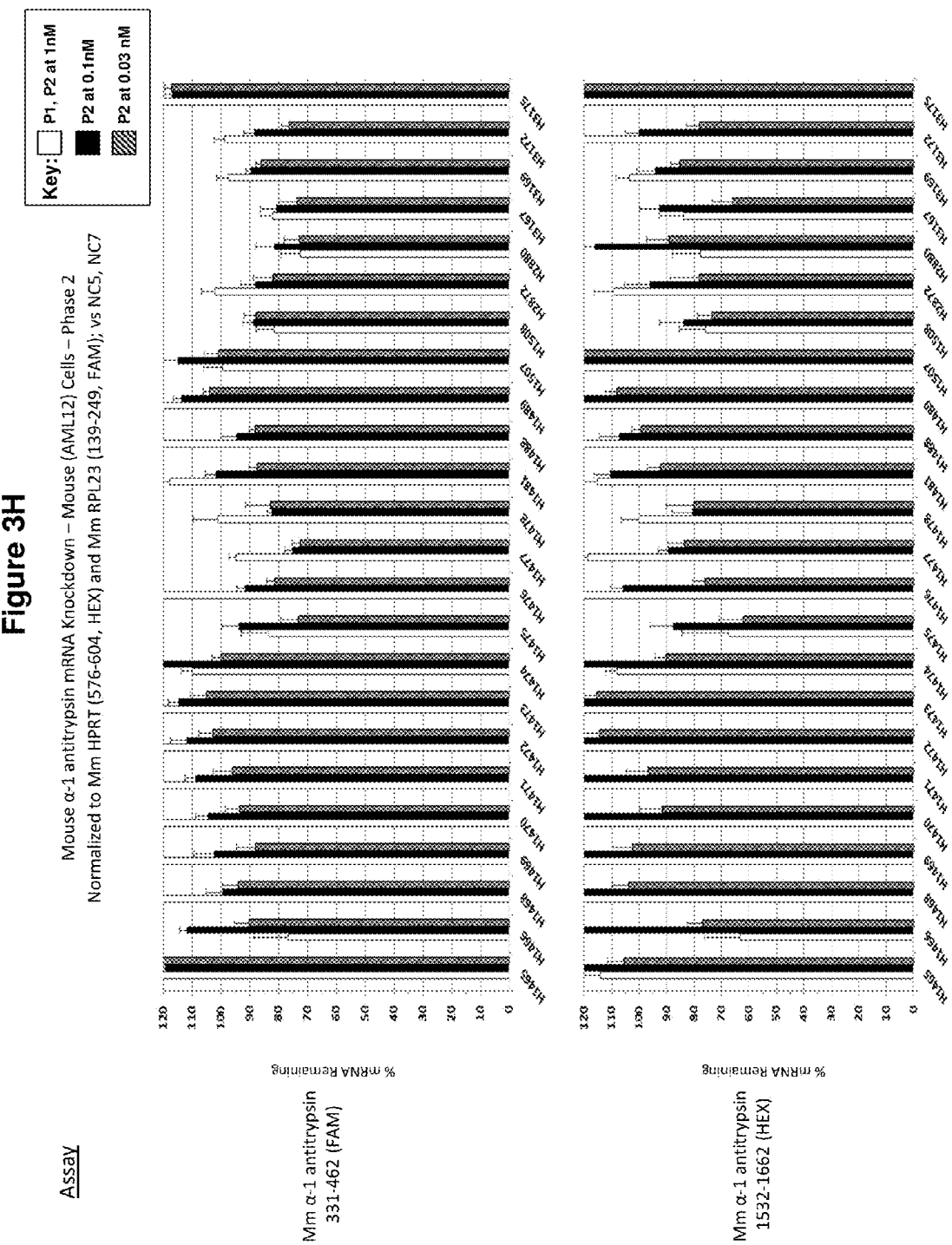

The present invention is directed to compositions that contain nucleic acids, for example double stranded RNA ("dsRNA"), and methods for preparing them, that are capable of reducing the level and/or expression of the α-1 antitrypsin gene in vivo or in vitro. One of the strands of the dsRNA contains a region of nucleotide sequence that has a length that ranges from 19 to 35 nucleotides that can direct the destruction and/or translational inhibition of the targeted α-1 antitrypsin transcript.

DEFINITIONS

Unless defined otherwise, all technical and scientific terms used herein have the meaning commonly understood by a person skilled in the art to which this invention belongs. The following references provide one of skill with a general definition of many of the terms used in this invention: Singleton et al., Dictionary of Microbiology and Molecular Biology (2nd ed. 1994); The Cambridge Dictionary of Science and Technology (Walker ed., 1988); The Glossary of Genetics, 5th Ed., R. Rieger et al. (eds.), Springer Verlag (1991); and Hale & Marham, The Harper Collins Dictionary of Biology (1991). As used herein, the following terms have the meanings ascribed to them below, unless specified otherwise.

The present invention features one or more DsiRNA molecules that can modulate (e.g., inhibit) α-1 antitrypsin expression. The DsiRNAs of the invention optionally can be used in combination with modulators of other genes and/or gene products associated with the maintenance or development of diseases or disorders associated with α-1 antitrypsin misregulation (e.g., tumor formation and/or growth, etc.). The DsiRNA agents of the invention modulate α-1 antitrypsin RNAs such as those corresponding to the cDNA sequences referred to by GenBank Accession Nos. NM_000295.4 (human α-1 antitrypsin) and NM_009246.3 (mouse Serpina1d), which are referred to herein generally as "α-1 antitrypsin."

The below description of the various aspects and embodiments of the invention is provided with reference to exemplary α-1 antitrypsin RNAs, generally referred to herein as α-1 antitrypsin. However, such reference is meant to be exemplary only and the various aspects and embodiments of the invention are also directed to alternate α-1 antitrypsin RNAs, such as mutant α-1 antitrypsin RNAs or additional α-1 antitrypsin splice variants. Certain aspects and embodiments are also directed to other genes involved in α-1 antitrypsin pathways, including genes whose misregulation acts in association with that of α-1 antitrypsin (or is affected or affects α-1 antitrypsin regulation) to produce phenotypic effects that may be targeted for treatment (e.g., tumor formation and/or growth, etc.). BAK1, Noxa, BCL2L11, Bcl-2-associated death promoter, PCNA, DAD1, TNKS and BH3 interacting domain death agonist are examples of genes that interact with α-1 antitrypsin. Such additional genes, including those of pathways that act in coordination with α-1 antitrypsin, can be targeted using dsRNA and the methods described herein for use of α-1 antitrypsin-targeting dsRNAs. Thus, the inhibition and the effects of such inhibition of the other genes can be performed as described herein.

The term "α-1 antitrypsin" refers to nucleic acid sequences encoding a α-1 antitrypsin protein, peptide, or polypeptide (e.g., α-1 antitrypsin transcripts, such as the sequences of α-1 antitrypsin Genbank Accession Nos. NM_000295.4 and NM_009246.3). In certain embodiments, the term "α-1 antitrypsin" is also meant to include other α-1 antitrypsin encoding sequence, such as other α-1 antitrypsin isoforms, mutant α-1 antitrypsin genes, splice variants of α-1 antitrypsin genes, and α-1 antitrypsin gene polymorphisms. The term "α-1 antitrypsin" is also used to refer to the polypeptide gene product of an α-1 antitrypsin gene/transcript, e.g., an α-1 antitrypsin protein, peptide, or polypeptide, such as those encoded by α-1 antitrypsin Genbank Accession Nos. NP_000286.3 and NP_033272.1.

As used herein, a "α-1 antitrypsin-associated disease or disorder" refers to a disease or disorder known in the art to be associated with altered α-1 antitrypsin expression, level and/or activity. Notably, a "α-1 antitrypsin-associated disease or disorder" includes diseases or disorders of the liver including, but not limited to, chronic liver disease, liver inflammation, cirrhosis, liver fibrosis, and/or hepatocellular carcinoma.

An anti-α-1 antitrypsin dsRNA of the invention is deemed to possess "α-1 antitrypsin inhibitory activity" if a statistically significant reduction in α-1 antitrypsin RNA (or when the α-1 antitrypsin protein is assessed, α-1 antitrypsin protein levels) is seen when an anti-α-1 antitrypsin dsRNA of the invention is administered to a system (e.g., cell-free in vitro system), cell, tissue or organism, as compared to a selected control. The distribution of experimental values and the number of replicate assays performed will tend to dictate the parameters of what levels of reduction in α-1 antitrypsin RNA (either as a % or in absolute terms) is deemed statistically significant (as assessed by standard methods of determining statistical significance known in the art). However, in certain embodiments, "α-1 antitrypsin inhibitory activity" is defined based upon a % or absolute level of reduction in the level of α-1 antitrypsin in a system, cell, tissue or organism. For example, in certain embodiments, a dsRNA of the invention is deemed to possess α-1 antitrypsin inhibitory activity if at least a 5% reduction or at least a 10% reduction in α-1 antitrypsin RNA is observed in the presence of a dsRNA of the invention relative to α-1 antitrypsin levels seen for a suitable control. (For example, in vivo α-1 antitrypsin levels in a tissue and/or subject can, in certain embodiments, be deemed to be inhibited by a dsRNA agent of the invention if, e.g., a 5% or 10% reduction in α-1 antitrypsin levels is observed relative to a control.) In certain other embodiments, a dsRNA of the invention is deemed to possess α-1 antitrypsin inhibitory activity if α-1 antitrypsin RNA levels are observed to be reduced by at least 15% relative to a selected control, by at least 20% relative to a selected control, by at least 25% relative to a selected control, by at least 30% relative to a selected control, by at least 35% relative to a selected control, by at least 40% relative to a selected control, by at least 45% relative to a selected control, by at least 50% relative to a selected control, by at least 55% relative to a selected control, by at least 60% relative to a selected control, by at least 65% relative to a selected control, by at least 70% relative to a selected control, by at least 75% relative to a selected control, by at least 80% relative to a selected control, by at least 85% relative to a selected control, by at least 90% relative to a selected control, by at least 95% relative to a selected control, by at least 96% relative to a selected control, by at least 97% relative to a selected control, by at least 98% relative to a selected control or by at least 99% relative to a selected control. In some embodiments, complete inhibition of α-1 antitrypsin is required for a dsRNA to be deemed to possess α-1 antitrypsin inhibitory activity. In certain models (e.g., cell culture), a dsRNA is deemed to possess α-1 antitrypsin inhibitory activity if at least a 50% reduction in α-1 antitrypsin levels is observed relative to a suitable control. In certain other embodiments, a dsRNA is deemed to possess α-1 antitrypsin inhibitory activity if at least an 80% reduction in α-1 antitrypsin levels is observed relative to a suitable control.

By way of specific example, in Example 2 below, a series of DsiRNAs targeting α-1 antitrypsin were tested for the ability to reduce α-1 antitrypsin mRNA levels in human Huh7 or mouse AML12 cells in vitro, at 1 nM concentrations in the environment of such cells and in the presence of a transfection agent (Lipofectamine™ RNAiMAX, Invitrogen). Within Example 2 below, α-1 antitrypsin inhibitory activity was ascribed to those DsiRNAs that were observed to effect at least a 70% reduction of α-1 antitrypsin mRNA levels under the assayed conditions. It is contemplated that α-1 antitrypsin inhibitory activity could also be attributed to a dsRNA under either more or less stringent conditions than those employed for Example 2 below, even when the same or a similar assay and conditions are employed. For example, in certain embodiments, a tested dsRNA of the invention is deemed to possess α-1 antitrypsin inhibitory activity if at least a 10% reduction, at least a 20% reduction, at least a 30% reduction, at least a 40% reduction, at least a 50% reduction, at least a 60% reduction, at least a 75% reduction, at least an 80% reduction, at least an 85% reduction, at least a 90% reduction, or at least a 95% reduction in α-1 antitrypsin mRNA levels is observed in a mammalian cell line in vitro at 1 nM dsRNA concentration or lower in the environment of a cell, relative to a suitable control.

Use of other endpoints for determination of whether a double stranded RNA of the invention possesses α-1 antitrypsin inhibitory activity is also contemplated. Specifically, in one embodiment, in addition to or as an alternative to assessing α-1 antitrypsin mRNA levels, the ability of a tested dsRNA to reduce α-1 antitrypsin protein levels (e.g., at 48 hours after contacting a mammalian cell in vitro or in vivo) is assessed, and a tested dsRNA is deemed to possess α-1 antitrypsin inhibitory activity if at least a 10% reduction, at least a 20% reduction, at least a 30% reduction, at least a 40% reduction, at least a 50% reduction, at least a 60% reduction, at least a 70% reduction, at least a 75% reduction, at least an 80% reduction, at least an 85% reduction, at least a 90% reduction, or at least a 95% reduction in α-1 antitrypsin protein levels is observed in a mammalian cell contacted with the assayed double stranded RNA in vitro or in vivo, relative to a suitable control. Additional endpoints contemplated include, e.g., assessment of a phenotype associated with reduction of α-1 antitrypsin levels—e.g., reduction of chronic liver disease, liver inflammation, cirrhosis, liver fibrosis, and/or hepatocellular carcinoma, as assessed directly or via assessment of appropriate markers and/or indicators of such liver disease or disorder.

α-1 antitrypsin inhibitory activity can also be evaluated over time (duration) and over concentration ranges (potency), with assessment of what constitutes a dsRNA possessing α-1 antitrypsin inhibitory activity adjusted in accordance with concentrations administered and duration of time following administration. Thus, in certain embodiments, a dsRNA of the invention is deemed to possess α-1 antitrypsin inhibitory activity if at least a 50% reduction in α-1 antitrypsin activity is observed/persists at a duration of time of 2 hours, 5 hours, 10 hours, 1 day, 2 days, 3 days, 4 days, 5 days, 6 days, 7 days, 8 days, 9 days, 10 days or more after administration of the dsRNA to a cell or organism. In additional embodiments, a dsRNA of the invention is deemed to be a potent α-1 antitrypsin inhibitory agent if α-1 antitrypsin inhibitory activity (e.g., in certain embodiments, at least 50% inhibition of α-1 antitrypsin) is observed at a concentration of 1 nM or less, 500 pM or less, 200 pM or less, 100 pM or less, 50 pM or less, 20 pM or less, 10 pM or less, 5 pM or less, 2 pM or less or even 1 pM or less in the environment of a cell, for example, within an in vitro assay for α-1 antitrypsin inhibitory activity as described herein. In certain embodiments, a potent α-1 antitrypsin inhibitory dsRNA of the invention is defined as one that is capable of α-1 antitrypsin inhibitory activity (e.g., in certain embodiments, at least 20% reduction of α-1 antitrypsin levels) at a formulated concentration of 10 mg/kg or less when administered to a subject in an effective delivery vehicle (e.g., an effective lipid nanoparticle formulation). Preferably, a potent α-1 antitrypsin inhibitory dsRNA of the invention is defined as one that is capable of α-1 antitrypsin inhibitory activity (e.g., in certain embodiments, at least 50% reduction of α-1 antitrypsin levels) at a formulated concentration of 5 mg/kg or less when administered to a subject in an effective delivery vehicle. More preferably, a potent α-1 antitrypsin inhibitory dsRNA of the invention is defined as one that is capable of α-1 antitrypsin inhibitory activity (e.g., in certain embodiments, at least 50% reduction of α-1 antitrypsin levels) at a formulated concentration of 5 mg/kg or less when administered to a subject in an effective delivery vehicle. Optionally, a potent α-1 antitrypsin inhibitory dsRNA of the invention is defined as one that is capable of α-1 antitrypsin inhibitory activity (e.g., in certain embodiments, at least 50% reduction of α-1 antitrypsin levels) at a formulated concentration of 2 mg/kg or less, or even 1 mg/kg or less, when administered to a subject in an effective delivery vehicle. Exemplary discrete formulated concentrations of α-1 antitrypsin-targeting RNAi agents of the invention include about 5 mg/kg, about 2 mg/kg, about 1 mg/kg, about 500 µg/kg, about 250 µg/kg, about 100 µg/kg, about 50 µg/kg, about 25 µg/kg, about 10 µg/kg, about 5 µg/kg, about 2.5 µg/kg, about 1 µg/kg, about 500 ng/kg, about 250 ng/kg, about 100 ng/kg, about 50 ng/kg, about 25 ng/kg, about 10 ng/kg, about 5 ng/kg, about 2.5 ng/kg, about 1 ng/kg and about 500 pg/kg.

About: As used herein, the term "about" means+/−10% of the recited value. Use of "about" is contemplated in reference to all ranges and values recited herein.

In certain embodiments, the phrase "consists essentially of" is used in reference to the anti-α-1 antitrypsin dsRNAs of the invention. In some such embodiments, "consists essentially of" refers to a composition that comprises a dsRNA of the invention which possesses at least a certain level of α-1 antitrypsin inhibitory activity (e.g., at least 50% α-1 antitrypsin inhibitory activity) and that also comprises one or more additional components and/or modifications that do not significantly impact the α-1 antitrypsin inhibitory activity of the dsRNA. For example, in certain embodiments, a composition "consists essentially of" a dsRNA of the invention where modifications of the dsRNA of the invention and/or dsRNA-associated components of the composition do not alter the α-1 antitrypsin inhibitory activity (optionally including potency or duration of α-1 antitrypsin inhibitory activity) by greater than 3%, greater than 5%, greater than 10%, greater than 15%, greater than 20%, greater than 25%, greater than 30%, greater than 35%, greater than 40%, greater than 45%, or greater than 50% relative to the dsRNA of the invention in isolation. In certain embodiments, a composition is deemed to consist essentially of a dsRNA of the invention even if more dramatic reduction of α-1 antitrypsin inhibitory activity (e.g., 80% reduction, 90% reduction, etc. in efficacy, duration and/or potency) occurs in the presence of additional components or modifications, yet where α-1 antitrypsin inhibitory activity is not significantly elevated (e.g., observed levels of α-1 antitrypsin inhibitory activity are within 10% those observed for the dsRNA of the invention) in the presence of additional components and/or modifications.

As used herein, the term "nucleic acid" refers to deoxyribonucleotides, ribonucleotides, or modified nucleotides, and polymers thereof in single- or double-stranded form. The term encompasses nucleic acids containing known nucleotide analogs or modified backbone residues or linkages, which are synthetic, naturally occurring, and non-naturally occurring, which have similar binding properties as the reference nucleic acid, and which are metabolized in a manner similar to the reference nucleotides. Examples of such analogs include, without limitation, phosphorothioates, phosphoramidates, methyl phosphonates, chiral-methyl phosphonates, 2-O-methyl ribonucleotides, peptide-nucleic acids (PNAs) and unlocked nucleic acids (UNAs or unlocked nucleobase analogs; see, e.g., Jensen et al. *Nucleic Acids Symposium Series* 52: 133-4), and derivatives thereof.

As used herein, "nucleotide" is used as recognized in the art to include those with natural bases (standard), and modified bases well known in the art. Such bases are generally located at the 1' position of a nucleotide sugar moiety. Nucleotides generally comprise a base, sugar and a phosphate group. The nucleotides can be unmodified or modified at the sugar, phosphate and/or base moiety, (also referred to interchangeably as nucleotide analogs, modified nucleotides, non-natural nucleotides, non-standard nucleotides and other; see, e.g., Usman and McSwiggen, supra; Eckstein, et al., International PCT Publication No. WO 92/07065; Usman et al, International PCT Publication No. WO 93/15187; Uhlman & Peyman, supra, all are hereby incorporated by reference herein). There are several examples of modified nucleic acid bases known in the art as summarized by Limbach, et al, *Nucleic Acids Res.* 22:2183, 1994. Some of the non-limiting examples of base modifications that can be introduced into nucleic acid molecules include, hypoxanthine, purine, pyridin-4-one, pyridin-2-one, phenyl, pseudouracil, 2,4,6-trimethoxy benzene, 3-methyl uracil, dihydrouridine, naphthyl, aminophenyl, 5-alkylcytidines (e.g., 5-methylcytidine), 5-alkyluridines (e.g., ribothymidine), 5-halouridine (e.g., 5-bromouridine) or 6-azapyrimidines or 6-alkylpyrimidines (e.g. 6-methyluridine), propyne, and others (Burgin, et al., Biochemistry 35:14090, 1996; Uhlman & Peyman, supra). By "modified bases" in this aspect is meant nucleotide bases other than adenine, guanine, cytosine and uracil at 1' position or their equivalents.

As used herein, "modified nucleotide" refers to a nucleotide that has one or more modifications to the nucleoside, the nucleobase, pentose ring, or phosphate group. For example, modified nucleotides exclude ribonucleotides containing adenosine monophosphate, guanosine monophosphate, uridine monophosphate, and cytidine monophosphate and deoxyribonucleotides containing deoxyadenosine monophosphate, deoxyguanosine monophosphate, deoxythymidine monophosphate, and deoxycytidine monophosphate. Modifications include those naturally occurring that result from modification by enzymes that modify nucleotides, such as methyltransferases. Modified nucleotides also include synthetic or non-naturally occurring nucleotides. Synthetic or non-naturally occurring modifications in nucleotides include those with 2' modifications, e.g., 2'-methoxyethoxy, 2'-fluoro, 2'-allyl, 2'-O—[2-(methylamino)-2-oxoethyl], 4'-thio, 4'-$CH_2$—O-2'-bridge, 4'-$(CH_2)_2$—O-2'-bridge, 2'-LNA or other bicyclic or "bridged" nucleoside analog, and 2'-O—(N-methylcarbamate) or those comprising base analogs. In connection with 2'-modified nucleotides as described for the present disclosure, by "amino" is meant 2'-$NH_2$ or 2'-O—$NH_2$, which can be modified or unmodified. Such modified groups are described, e.g., in Eckstein et al., U.S. Pat. No. 5,672,695 and Matulic-Adamic et al., U.S. Pat. No. 6,248,878. "Modified nucleotides" of the instant invention can also include nucleotide analogs as described above.

In reference to the nucleic acid molecules of the present disclosure, modifications may exist upon these agents in patterns on one or both strands of the double stranded ribonucleic acid (dsRNA). As used herein, "alternating positions" refers to a pattern where every other nucleotide is a modified nucleotide or there is an unmodified nucleotide (e.g., an unmodified ribonucleotide) between every modified nucleotide over a defined length of a strand of the dsRNA (e.g., 5'-MNMNMN-3'; 3'-MNMNMN-5'; where M is a modified nucleotide and N is an unmodified nucleotide). The modification pattern starts from the first nucleotide position at either the 5' or 3' terminus according to a position numbering convention, e.g., as described herein (in certain embodiments, position 1 is designated in reference to the terminal residue of a strand following a projected Dicer cleavage event of a DsiRNA agent of the invention; thus, position 1 does not always constitute a 3' terminal or 5' terminal residue of a pre-processed agent of the invention). The pattern of modified nucleotides at alternating positions may run the full length of the strand, but in certain embodiments includes at least 4, 6, 8, 10, 12, 14 nucleotides containing at least 2, 3, 4, 5, 6 or 7 modified nucleotides, respectively. As used herein, "alternating pairs of positions" refers to a pattern where two consecutive modified nucleotides are separated by two consecutive unmodified nucleotides over a defined length of a strand of the dsRNA (e.g., 5'-MMNNMMNNMMNN-3'; 3'-MMNNMMNNMMNN-5'; where M is a modified nucleotide and N is an unmodified nucleotide). The modification pattern starts from the first nucleotide position at either the 5' or 3' terminus according to a position numbering convention such as those described herein. The pattern of modified nucleotides at alternating positions may run the full length of the strand, but preferably includes at least 8, 12, 16, 20, 24, 28 nucleotides containing at least 4, 6, 8, 10, 12 or 14 modified nucleotides, respectively. It is emphasized that the above modification patterns are exemplary and are not intended as limitations on the scope of the invention.

As used herein, "base analog" refers to a heterocyclic moiety which is located at the 1' position of a nucleotide sugar moiety in a modified nucleotide that can be incorporated into a nucleic acid duplex (or the equivalent position in a nucleotide sugar moiety substitution that can be incorporated into a nucleic acid duplex). In the dsRNAs of the invention, a base analog is generally either a purine or pyrimidine base excluding the common bases guanine (G), cytosine (C), adenine (A), thymine (T), and uracil (U). Base analogs can duplex with other bases or base analogs in dsRNAs. Base analogs include those useful in the compounds and methods of the invention, e.g., those disclosed in U.S. Pat. Nos. 5,432,272 and 6,001,983 to Benner and US Patent Publication No. 20080213891 to Manoharan, which are herein incorporated by reference. Non-limiting examples of bases include hypoxanthine (I), xanthine (X), 3β-D-ribofuranosyl-(2,6-diaminopyrimidine) (K), 3-β-D-ribofuranosyl-(1-methyl-pyrazolo[4,3-d]pyrimidine-5,7(4H,6H)-dione) (P), iso-cytosine (iso-C), iso-guanine (iso-G), 1-β-D-ribofuranosyl-(5-nitroindole), 1-β-D-ribofuranosyl-(3-nitropyrrole), 5-bromouracil, 2-aminopurine, 4-thio-dT, 7-(2-thienyl)-imidazo[4,5-b]pyridine (Ds) and pyrrole-2-carbaldehyde (Pa), 2-amino-6-(2-thienyl)purine (S), 2-oxopyridine (Y), difluorotolyl, 4-fluoro-6-methylbenzimidazole, 4-methylbenzimidazole, 3-methyl isocarbostyrilyl, 5-methyl isocarbostyrilyl, and 3-methyl-7-propynyl isocarbostyrilyl, 7-azaindolyl, 6-methyl-7-azaindolyl, imidizopyridinyl, 9-methyl-imidizopyridinyl, pyrrolopyrizinyl, isocarbostyrilyl, 7-propynyl isocarbostyrilyl, propynyl-7-azaindolyl, 2,4,5-trimethylphenyl, 4-methylindolyl, 4,6-dimethylindolyl, phenyl, napthalenyl, anthracenyl, phenanthracenyl, pyrenyl, stilbenzyl, tetracenyl, pentacenyl, and structural derivates thereof (Schweitzer et al., J. Org. Chem., 59:7238-7242 (1994); Berger et al., Nucleic Acids Research, 28(15):2911-2914 (2000); Moran et al., J. Am. Chem. Soc., 119:2056-2057 (1997); Morales et al., J. Am. Chem. Soc., 121:2323-2324 (1999); Guckian et al., J. Am. Chem. Soc., 118:8182-8183 (1996); Morales et al., J. Am. Chem. Soc., 122(6):1001-1007 (2000); McMinn et al., J. Am. Chem. Soc., 121:11585-11586 (1999); Guckian et al., J. Org. Chem., 63:9652-9656 (1998); Moran et al., Proc. Natl. Acad. Sci., 94:10506-10511 (1997); Das et al., J. Chem. Soc., Perkin Trans., 1:197-206 (2002); Shibata et al., J. Chem. Soc., Perkin Trans., 1: 1605-1611 (2001); Wu et al., J. Am. Chem. Soc., 122(32):7621-7632 (2000); O'Neill et al., J. Org. Chem., 67:5869-5875 (2002); Chaudhuri et al., J. Am. Chem. Soc., 117:10434-10442 (1995); and U.S. Pat. No. 6,218,108). Base analogs may also be a universal base.

As used herein, "universal base" refers to a heterocyclic moiety located at the 1' position of a nucleotide sugar moiety in a modified nucleotide, or the equivalent position in a nucleotide sugar moiety substitution, that, when present in a nucleic acid duplex, can be positioned opposite more than one type of base without altering the double helical structure (e.g., the structure of the phosphate backbone). Additionally, the universal base does not destroy the ability of the single stranded nucleic acid in which it resides to duplex to a target nucleic acid. The ability of a single stranded nucleic acid containing a universal base to duplex a target nucleic can be assayed by methods apparent to one in the art (e.g., UV absorbance, circular dichroism, gel shift, single stranded nuclease sensitivity, etc.). Additionally, conditions under which duplex formation is observed may be varied to determine duplex stability or formation, e.g., temperature, as melting temperature (Tm) correlates with the stability of nucleic acid duplexes. Compared to a reference single stranded nucleic acid that is exactly complementary to a target nucleic acid, the single stranded nucleic acid containing a universal base forms a duplex with the target nucleic acid that has a lower Tm than a duplex formed with the complementary nucleic acid. However, compared to a reference single stranded nucleic acid in which the universal base has been replaced with a base to generate a single mismatch, the single stranded nucleic acid containing the universal base forms a duplex with the target nucleic acid that has a higher Tm than a duplex formed with the nucleic acid having the mismatched base.

Some universal bases are capable of base pairing by forming hydrogen bonds between the universal base and all of the bases guanine (G), cytosine (C), adenine (A), thymine (T), and uracil (U) under base pair forming conditions. A universal base is not a base that forms a base pair with only one single complementary base. In a duplex, a universal base may form no hydrogen bonds, one hydrogen bond, or more than one hydrogen bond with each of G, C, A, T, and U opposite to it on the opposite strand of a duplex. Preferably, the universal bases does not interact with the base opposite to it on the opposite strand of a duplex. In a duplex, base pairing between a universal base occurs without altering the double helical structure of the phosphate backbone. A universal base may also interact with bases in adjacent nucleotides on the same nucleic acid strand by stacking interactions. Such stacking interactions stabilize the duplex, especially in situations where the universal base does not form any hydrogen bonds with the base positioned opposite to it on the opposite strand of the duplex. Non-limiting examples of universal-binding nucleotides include inosine, 1-β-D-ribofuranosyl-5-nitroindole, and/or 1-β-D-ribofuranosyl-3-nitropyrrole (US Pat. Appl. Publ. No. 20070254362 to Quay et al.; Van Aerschot et al., An acyclic 5-nitroindazole nucleoside analogue as ambiguous nucleoside. Nucleic Acids Res. 1995 Nov. 11; 23(21):4363-70; Loakes et al., 3-Nitropyrrole and 5-nitroindole as universal bases in primers for DNA sequencing and PCR. Nucleic Acids Res. 1995 Jul. 11; 23(13):2361-6; Loakes and Brown, 5-Nitroindole as an universal base analogue. Nucleic Acids Res. 1994 Oct. 11; 22(20):4039-43).

As used herein, "loop" refers to a structure formed by a single strand of a nucleic acid, in which complementary regions that flank a particular single stranded nucleotide region hybridize in a way that the single stranded nucleotide region between the complementary regions is excluded from duplex formation or Watson-Crick base pairing. A loop is a single stranded nucleotide region of any length. Examples of loops include the unpaired nucleotides present in such structures as hairpins, stem loops, or extended loops.

As used herein, "extended loop" in the context of a dsRNA refers to a single stranded loop and in addition 1, 2, 3, 4, 5, 6 or up to 20 base pairs or duplexes flanking the loop. In an extended loop, nucleotides that flank the loop on the 5' side form a duplex with nucleotides that flank the loop on the 3' side. An extended loop may form a hairpin or stem loop.

As used herein, "tetraloop" in the context of a dsRNA refers to a loop (a single stranded region) consisting of four nucleotides that forms a stable secondary structure that contributes to the stability of adjacent Watson-Crick hybridized nucleotides. Without being limited to theory, a tetraloop may stabilize an adjacent Watson-Crick base pair by stacking interactions. In addition, interactions among the four nucleotides in a tetraloop include but are not limited to non-Watson-Crick base pairing, stacking interactions, hydrogen bonding, and contact interactions (Cheong et al., *Nature* 1990 Aug. 16; 346(6285):680-2; Heus and Pardi, *Science* 1991 Jul. 12; 253(5016):191-4). A tetraloop confers an increase in the melting temperature (Tm) of an adjacent duplex that is higher than expected from a simple model loop sequence consisting of four random bases. For example, a tetraloop can confer a melting temperature of at least 55° C. in 10 mM NaHPO$_4$ to a hairpin comprising a duplex of at least 2 base pairs in length. A tetraloop may contain ribonucleotides, deoxyribonucleotides, modified nucleotides, and combinations thereof. Examples of RNA tetraloops include the UNCG family of tetraloops (e.g., UUCG), the GNRA family of tetraloops (e.g., GAAA), and the CUUG tetraloop. (Woese et al., Proc Natl Acad Sci USA. 1990 November; 87(21):8467-71; Antao et al., Nucleic Acids Res. 1991 Nov. 11; 19(21):5901-5). Examples of DNA tetraloops include the d(GNNA) family of tetraloops (e.g., d(GTTA), the d(GNRA)) family of tetraloops, the d(GNAB) family of tetraloops, the d(CNNG) family of tetraloops, the d(TNCG) family of tetraloops (e.g., d(TTCG)). (Nakano et al. Biochemistry, 41 (48), 14281-14292, 2002.; SHINJI et al. Nippon Kagakkai Koen Yokoshu VOL. 78th; NO. 2; PAGE. 731 (2000).)

As used herein, the term "siRNA" refers to a double stranded nucleic acid in which each strand comprises RNA, RNA analog(s) or RNA and DNA. The siRNA comprises between 19 and 23 nucleotides or comprises 21 nucleotides. The siRNA typically has 2 bp overhangs on the 3' ends of each strand such that the duplex region in the siRNA comprises 17-21 nucleotides, or 19 nucleotides. Typically, the antisense strand of the siRNA is sufficiently complementary with the target sequence of the α-1 antitrypsin gene/RNA.

Where a first sequence is referred to as "substantially complementary" with respect to a second sequence herein, the two sequences can be fully complementary, or they may form one or more, but generally not more than 4, 3 or 2 mismatched base pairs upon hybridization, while retaining the ability to hybridize under the conditions most relevant to their ultimate application. However, where two oligonucleotides are designed to form, upon hybridization, one or more single stranded overhangs, such overhangs shall not be regarded as mismatches with regard to the determination of complementarity. For example, a dsRNA comprising one oligonucleotide 21 nucleotides in length and another oligonucleotide 23 nucleotides in length, wherein the longer oligonucleotide comprises a sequence of 21 nucleotides that is fully complementary to the shorter oligonucleotide, may yet be referred to as "fully complementary" for the purposes of the invention.

The term "double-stranded RNA" or "dsRNA", as used herein, refers to a complex of ribonucleic acid molecules, having a duplex structure comprising two anti-parallel and substantially complementary, as defined above, nucleic acid strands. The two strands forming the duplex structure may be different portions of one larger RNA molecule, or they may be separate RNA molecules. Where separate RNA molecules, such dsRNA are often referred to as siRNA ("short interfering RNA") or DsiRNA ("Dicer substrate siRNAs"). Where the two strands are part of one larger molecule, and therefore are connected by an uninterrupted chain of nucleotides between the 3'-end of one strand and the 5' end of the respective other strand forming the duplex structure, the connecting RNA chain is referred to as a "hairpin loop", "short hairpin RNA" or "shRNA". Where the two strands are connected covalently by means other than an uninterrupted chain of nucleotides between the 3'-end of one strand and the 5' end of the respective other strand forming the duplex structure, the connecting structure is referred to as a "linker". The RNA strands may have the same or a different number of nucleotides. The maximum number of base pairs is the number of nucleotides in the shortest strand of the dsRNA minus any overhangs that are present in the duplex. In addition to the duplex structure, a dsRNA may comprise one or more nucleotide overhangs. In addition, as used herein, "dsRNA" may include chemical modifications to ribonucleotides, internucleoside linkages, end-groups, caps, and conjugated moieties, including substantial modifications at multiple nucleotides and including all types of modifications disclosed herein or known in the art. Any such modifications, as used in an siRNA- or DsiRNA-type molecule, are encompassed by "dsRNA" for the purposes of this specification and claims.

The phrase "duplex region" refers to the region in two complementary or substantially complementary oligonucleotides that form base pairs with one another, either by Watson-Crick base pairing or other manner that allows for a duplex between oligonucleotide strands that are complementary or substantially complementary. For example, an oligonucleotide strand having 21 nucleotide units can base pair with another oligonucleotide of 21 nucleotide units, yet only 19 bases on each strand are complementary or substantially complementary, such that the "duplex region" consists of 19 base pairs. The remaining base pairs may, for example, exist as 5' and 3' overhangs. Further, within the duplex region, 100% complementarity is not required; substantial complementarity is allowable within a duplex region. Substantial complementarity refers to complementarity between the strands such that they are capable of annealing under biological conditions. Techniques to empirically determine if two strands are capable of annealing under biological conditions are well know in the art. Alternatively, two strands can be synthesized and added together under biological conditions to determine if they anneal to one another.

By definition, "sufficiently complementary" (contrasted with, e.g., "100% complementary") allows for one or more mismatches to exist between a dsRNA of the invention and the target RNA or cDNA sequence (e.g., α-1 antitrypsin mRNA), provided that the dsRNA possesses complementarity sufficient to trigger the destruction of the target RNA by the RNAi machinery (e.g., the RISC complex) or process. In certain embodiments, a "sufficiently complementary" dsRNA of the invention can harbor one, two, three or even four or more mismatches between the dsRNA sequence and the target RNA or cDNA sequence (e.g., in certain such embodiments, the antisense strand of the dsRNA harbors one, two, three, four, five or even six or more mismatches when aligned with the target RNA or cDNA sequence). Additional consideration of the preferred location of such mismatches within certain dsRNAs of the instant invention is considered in greater detail below.

As used herein "DsiRNAmm" refers to a DisRNA having a "mismatch tolerant region" containing one, two, three or four mismatched base pairs of the duplex formed by the sense and antisense strands of the DsiRNA, where such mismatches are positioned within the DsiRNA at a location(s) lying between (and thus not including) the two terminal base pairs of either end of the DsiRNA. The structure and mismatch positioning of exemplary forms of DsiRNAmm compositions are described in greater detail below.

Single-stranded nucleic acids that base pair over a number of bases are said to "hybridize." Hybridization is typically determined under physiological or biologically relevant conditions (e.g., intracellular: pH 7.2, 140 mM potassium ion; extracellular pH 7.4, 145 mM sodium ion). Hybridization conditions generally contain a monovalent cation and biologically acceptable buffer and may or may not contain a divalent cation, complex anions, e.g. gluconate from potassium gluconate, uncharged species such as sucrose, and inert polymers to reduce the activity of water in the sample, e.g. PEG. Such conditions include conditions under which base pairs can form.

Hybridization is measured by the temperature required to dissociate single stranded nucleic acids forming a duplex, i.e., (the melting temperature; Tm). Hybridization conditions are also conditions under which base pairs can form. Various conditions of stringency can be used to determine hybridization (see, e.g., Wahl, G. M. and S. L. Berger (1987) Methods Enzymol. 152:399; Kimmel, A. R. (1987) Methods Enzymol. 152:507). Stringent temperature conditions will ordinarily include temperatures of at least about 30° C., more preferably of at least about 37° C., and most preferably of at least about 42° C. The hybridization temperature for hybrids anticipated to be less than 50 base pairs in length should be 5-10° C. less than the melting temperature (Tm) of the hybrid, where Tm is determined according to the following equations. For hybrids less than 18 base pairs in length, Tm(° C.)=2 (# of A+T bases)+4 (# of G+C bases). For hybrids between 18 and 49 base pairs in length, Tm(° C.)=81.5+16.6 (log 10[Na+])+0.41 (% G+C)−(600/N), where N is the number of bases in the hybrid, and [Na+] is the concentration of sodium ions in the hybridization buffer ([Na+] for 1×SSC=0.165 M). For example, a hybridization determination buffer is shown in Table 1.

As used herein, "oligonucleotide strand" is a single stranded nucleic acid molecule. An oligonucleotide may comprise ribonucleotides, deoxyribonucleotides, modified nucleotides (e.g., nucleotides with 2' modifications, synthetic base analogs, etc.) or combinations thereof. Such modified oligonucleotides can be preferred over native forms because of properties such as, for example, enhanced cellular uptake and increased stability in the presence of nucleases.

As used herein, the term "ribonucleotide" encompasses natural and synthetic, unmodified and modified ribonucleotides. Modifications include changes to the sugar moiety, to the base moiety and/or to the linkages between ribonucleotides in the oligonucleotide. As used herein, the term "ribonucleotide" specifically excludes a deoxyribonucleotide, which is a nucleotide possessing a single proton group at the 2' ribose ring position.

As used herein, the term "deoxyribonucleotide" encompasses natural and synthetic, unmodified and modified deoxyribonucleotides. Modifications include changes to the sugar moiety, to the base moiety and/or to the linkages between deoxyribonucleotide in the oligonucleotide. As used herein, the term "deoxyribonucleotide" also includes a modified ribonucleotide that does not permit Dicer cleavage of a dsRNA agent, e.g., a 2'-O-methyl ribonucleotide, a phosphorothioate-modified ribonucleotide residue, etc., that does not permit Dicer cleavage to occur at a bond of such a residue.

As used herein, the term "PS-NA" refers to a phosphorothioate-modified nucleotide residue. The term "PS-NA" therefore encompasses both phosphorothioate-modified ribonucleotides ("PS-RNAs") and phosphorothioate-modified deoxyribonucleotides ("PS-DNAs").

As used herein, "Dicer" refers to an endoribonuclease in the RNase III family that cleaves a dsRNA or dsRNA-containing molecule, e.g., double-stranded RNA (dsRNA) or pre-microRNA (miRNA), into double-stranded nucleic acid fragments 19-25 nucleotides long, usually with a two-

TABLE 1

|  | final conc. | Vender | Cat# | Lot# | m.w./Stock | To make 50 mL solution |
|---|---|---|---|---|---|---|
| NaCl | 100 mM | Sigma | S-5150 | 41K8934 | 5M | 1 mL |
| KCl | 80 mM | Sigma | P-9541 | 70K0002 | 74.55 | 0.298 g |
| MgCl$_2$ | 8 mM | Sigma | M-1028 | 120K8933 | 1M | 0.4 mL |
| sucrose | 2% w/v | Fisher | BP220-212 | 907105 | 342.3 | 1 g |
| Tris-HCl | 16 mM | Fisher | BP1757-500 | 12419 | 1M | 0.8 mL |
| NaH$_2$PO$_4$ | 1 mM | Sigma | S-3193 | 52H-029515 | 120.0 | 0.006 g |
| EDTA | 0.02 mM | Sigma | E-7889 | 110K89271 | 0.5M | 2 μL |
| H$_2$O |  | Sigma | W-4502 | 51K2359 |  | to 50 mL |
| pH = 7.0 at 20° C. |  |  |  | adjust with HCl |  |  |

Useful variations on hybridization conditions will be readily apparent to those skilled in the art. Hybridization techniques are well known to those skilled in the art and are described, for example, in Benton and Davis (Science 196: 180, 1977); Grunstein and Hogness (Proc. Natl. Acad. Sci., USA 72:3961, 1975); Ausubel et al. (Current Protocols in Molecular Biology, Wiley Interscience, New York, 2001); Berger and Kimmel (Antisense to Molecular Cloning Techniques, 1987, Academic Press, New York); and Sambrook et al., Molecular Cloning: A Laboratory Manual, Cold Spring Harbor Laboratory Press, New York.

base overhang on the 3' end. With respect to certain dsRNAs of the invention (e.g., "DsiRNAs"), the duplex formed by a dsRNA region of an agent of the invention is recognized by Dicer and is a Dicer substrate on at least one strand of the duplex. Dicer catalyzes the first step in the RNA interference pathway, which consequently results in the degradation of a target RNA. The protein sequence of human Dicer is provided at the NCBI database under accession number NP_085124, hereby incorporated by reference.

Dicer "cleavage" can be determined as follows (e.g., see Collingwood et al., Oligonucleotides 18:187-200 (2008)). In a Dicer cleavage assay, RNA duplexes (100 pmol) are incubated in 20 μL of 20 mM Tris pH 8.0, 200 mM NaCl, 2.5 mM MgCl2 with or without 1 unit of recombinant human Dicer (Stratagene, La Jolla, Calif.) at 37° C. for 18-24 hours. Samples are desalted using a Performa SR 96-well plate (Edge Biosystems, Gaithersburg, Md.). Electrospray-ionization liquid chromatography mass spectroscopy (ESI-LCMS) of duplex RNAs pre- and post-treatment with Dicer is done using an Oligo HTCS system (Novatia, Princeton, N.J.; Hail et al., 2004), which consists of a ThermoFinnigan TSQ7000, Xcalibur data system, ProMass data processing software and Paradigm MS4 HPLC (Michrom BioResources, Auburn, Calif.). In this assay, Dicer cleavage occurs where at least 5%, 10%, 20%, 30%, 40%, 50%, 60%, 70%, 80%, 90%, 95%, or even 100% of the Dicer substrate dsRNA, (i.e., 25-30 bp, dsRNA, preferably 26-30 bp dsRNA) is cleaved to a shorter dsRNA (e.g., 19-23 bp dsRNA, preferably, 21-23 bp dsRNA).

As used herein, "Dicer cleavage site" refers to the sites at which Dicer cleaves a dsRNA (e.g., the dsRNA region of a DsiRNA agent of the invention). Dicer contains two RNase III domains which typically cleave both the sense and antisense strands of a dsRNA. The average distance between the RNase III domains and the PAZ domain determines the length of the short double-stranded nucleic acid fragments it produces and this distance can vary (Macrae et al. (2006) Science 311: 195-8). As shown in FIG. 1, Dicer is projected to cleave certain double-stranded ribonucleic acids of the instant invention that possess an antisense strand having a 2 nucleotide 3' overhang at a site between the $21^{st}$ and $22^{nd}$ nucleotides removed from the 3' terminus of the antisense strand, and at a corresponding site between the $21^{st}$ and $22^{nd}$ nucleotides removed from the 5' terminus of the sense strand. The projected and/or prevalent Dicer cleavage site(s) for dsRNA molecules distinct from those depicted in FIG. 1 may be similarly identified via art-recognized methods, including those described in Macrae et al. While the Dicer cleavage events depicted in FIG. 1 generate 21 nucleotide siRNAs, it is noted that Dicer cleavage of a dsRNA (e.g., DsiRNA) can result in generation of Dicer-processed siRNA lengths of 19 to 23 nucleotides in length. Indeed, in certain embodiments, a double-stranded DNA region may be included within a dsRNA for purpose of directing prevalent Dicer excision of a typically non-preferred 19mer or 20mer siRNA, rather than a 21mer.

In certain embodiments, dsRNAs of the invention are Dicer substrate siRNAs ("DsiRNAs"). DsiRNAs can possess certain advantages as compared to inhibitory nucleic acids that are not dicer substrates ("non-DsiRNAs"). Such advantages include, but are not limited to, enhanced duration of effect of a DsiRNA relative to a non-DsiRNA, as well as enhanced inhibitory activity of a DsiRNA as compared to a non-DsiRNA (e.g., a 19-23mer siRNA) when each inhibitory nucleic acid is suitably formulated and assessed for inhibitory activity in a mammalian cell at the same concentration (in this latter scenario, the DsiRNA would be identified as more potent than the non-DsiRNA). Detection of the enhanced potency of a DsiRNA relative to a non-DsiRNA is often most readily achieved at a formulated concentration (e.g., transfection concentration of the dsRNA) that results in the DsiRNA eliciting approximately 30-70% knockdown activity upon a target RNA (e.g., a mRNA). For active DsiRNAs, such levels of knockdown activity are most often achieved at in vitro mammalian cell DsiRNA transfection concentrations of 1 nM or less of as suitably formulated, and in certain instances are observed at DsiRNA transfection concentrations of 200 pM or less, 100 pM or less, 50 pM or less, 20 pM or less, 10 pM or less, 5 pM or less, or even 1 pM or less. Indeed, due to the variability among DsiRNAs of the precise concentration at which 30-70% knockdown of a target RNA is observed, construction of an $IC_{50}$ curve via assessment of the inhibitory activity of DsiRNAs and non-DsiRNAs across a range of effective concentrations is a preferred method for detecting the enhanced potency of a DsiRNA relative to a non-DsiRNA inhibitory agent.

As used herein, "overhang" refers to unpaired nucleotides, in the context of a duplex having one or more free ends at the 5' terminus or 3' terminus of a dsRNA. In certain embodiments, the overhang is a 3' or 5' overhang on the antisense strand or sense strand. In some embodiments, the overhang is a 3' overhang having a length of between one and six nucleotides, optionally one to five, one to four, one to three, one to two, two to six, two to five, two to four, two to three, three to six, three to five, three to four, four to six, four to five, five to six nucleotides, or one, two, three, four, five or six nucleotides. "Blunt" or "blunt end" means that there are no unpaired nucleotides at that end of the dsRNA, i.e., no nucleotide overhang. For clarity, chemical caps or non-nucleotide chemical moieties conjugated to the 3' end or 5' end of an siRNA are not considered in determining whether an siRNA has an overhang or is blunt ended. In certain embodiments, the invention provides a dsRNA molecule for inhibiting the expression of the α-1 antitrypsin target gene in a cell or mammal, wherein the dsRNA comprises an antisense strand comprising a region of complementarity which is complementary to at least a part of an mRNA formed in the expression of the α-1 antitrypsin target gene, and wherein the region of complementarity is less than 35 nucleotides in length, optionally 19-24 nucleotides in length or 25-30 nucleotides in length, and wherein the dsRNA, upon contact with a cell expressing the α-1 antitrypsin target gene, inhibits the expression of the α-1 antitrypsin target gene by at least 10%, 25%, or 40%.

As used herein, the term "RNA processing" refers to processing activities performed by components of the siRNA, miRNA or RNase H pathways (e.g., Drosha, Dicer, Argonaute2 or other RISC endoribonucleases, and RNaseH), which are described in greater detail below (see "RNA Processing" section below). The term is explicitly distinguished from the post-transcriptional processes of 5' capping of RNA and degradation of RNA via non-RISC- or non-RNase H-mediated processes. Such "degradation" of an RNA can take several forms, e.g. deadenylation (removal of a 3' poly(A) tail), and/or nuclease digestion of part or all of the body of the RNA by one or more of several endo- or exo-nucleases (e.g., RNase III, RNase P, RNase T1, RNase A (1, 2, 3, 4/5), oligonucleotidase, etc.).

By "homologous sequence" is meant a nucleotide sequence that is shared by one or more polynucleotide sequences, such as genes, gene transcripts and/or non-coding polynucleotides. For example, a homologous sequence can be a nucleotide sequence that is shared by two or more genes encoding related but different proteins, such as different members of a gene family, different protein epitopes, different protein isoforms or completely divergent genes, such as a cytokine and its corresponding receptors. A homologous sequence can be a nucleotide sequence that is shared by two or more non-coding polynucleotides, such as noncoding DNA or RNA, regulatory sequences, introns, and sites of transcriptional control or regulation. Homologous sequences can also include conserved sequence regions shared by more than one polynucleotide sequence. Homology does not need to be perfect homology (e.g., 100%), as partially homologous sequences are also contemplated by the instant invention (e.g., 99%, 98%, 97%, 96%, 95%, 94%, 93%, 92%, 91%, 90%, 89%, 88%, 87%, 86%, 85%, 84%, 83%, 82%, 81%, 80% etc.). Indeed, design and use of the dsRNA agents of the instant invention contemplates the possibility of using such dsRNA agents not only against target RNAs of α-1 antitrypsin possessing perfect complementarity with the presently described dsRNA agents, but also against target α-1 antitrypsin RNAs possessing sequences that are, e.g., only 99%, 98%, 97%, 96%, 95%, 94%, 93%, 92%, 91%, 90%, 89%, 88%, 87%, 86%, 85%, 84%, 83%, 82%, 81%, 80% etc. complementary to said dsRNA agents. Similarly, it is contemplated that the presently described dsRNA agents of the instant invention might be readily altered by the skilled artisan to enhance the extent of complementarity between said dsRNA agents and a target α-1 antitrypsin RNA, e.g., of a specific allelic variant of α-1 antitrypsin (e.g., an allele of enhanced therapeutic interest). Indeed, dsRNA agent sequences with insertions, deletions, and single point mutations relative to the target α-1 antitrypsin sequence can also be effective for inhibition. Alternatively, dsRNA agent sequences with nucleotide analog substitutions or insertions can be effective for inhibition.

Sequence identity may be determined by sequence comparison and alignment algorithms known in the art. To determine the percent identity of two nucleic acid sequences (or of two amino acid sequences), the sequences are aligned for comparison purposes (e.g., gaps can be introduced in the first sequence or second sequence for optimal alignment). The nucleotides (or amino acid residues) at corresponding nucleotide (or amino acid) positions are then compared. When a position in the first sequence is occupied by the same residue as the corresponding position in the second sequence, then the molecules are identical at that position. The percent identity between the two sequences is a function of the number of identical positions shared by the sequences (i.e., % homology=# of identical positions/total # of positions×100), optionally penalizing the score for the number of gaps introduced and/or length of gaps introduced.

The comparison of sequences and determination of percent identity between two sequences can be accomplished using a mathematical algorithm. In one embodiment, the alignment generated over a certain portion of the sequence aligned having sufficient identity but not over portions having low degree of identity (i.e., a local alignment). A preferred, non-limiting example of a local alignment algorithm utilized for the comparison of sequences is the algorithm of Karlin and Altschul (1990) *Proc. Natl. Acad. Sci. USA* 87:2264-68, modified as in Karlin and Altschul (1993) *Proc. Natl. Acad. Sci. USA* 90:5873-77. Such an algorithm is incorporated into the BLAST programs (version 2.0) of Altschul, et al. (1990) *J. Mol. Biol.* 215:403-10.

In another embodiment, a gapped alignment, the alignment is optimized by introducing appropriate gaps, and percent identity is determined over the length of the aligned sequences (i.e., a gapped alignment). To obtain gapped alignments for comparison purposes, Gapped BLAST can be utilized as described in Altschul et al., (1997) Nucleic Acids Res. 25(17):3389-3402. In another embodiment, a global alignment the alignment is optimized by introducing appropriate gaps, and percent identity is determined over the entire length of the sequences aligned. (i.e., a global alignment). A preferred, non-limiting example of a mathematical algorithm utilized for the global comparison of sequences is the algorithm of Myers and Miller, CABIOS (1989). Such an algorithm is incorporated into the ALIGN program (version 2.0) which is part of the GCG sequence alignment software package. When utilizing the ALIGN program for comparing amino acid sequences, a PAM120 weight residue table, a gap length penalty of 12, and a gap penalty of 4 can be used.

Greater than 80% sequence identity, e.g., 80%, 81%, 82%, 83%, 84%, 85%, 86%, 87%, 88%, 89%, 90%, 91%, 92%, 93%, 94%, 95%, 96%, 97%, 98%, 99% or even 100% sequence identity, between the dsRNA antisense strand and the portion of the α-1 antitrypsin RNA sequence is preferred. Alternatively, the dsRNA may be defined functionally as a nucleotide sequence (or oligonucleotide sequence) that is capable of hybridizing with a portion of the α-1 antitrypsin RNA (e.g., 400 mM NaCl, 40 mM PIPES pH 6.4, 1 mM EDTA, 50° C. or 70° C. hybridization for 12-16 hours; followed by washing). Additional preferred hybridization conditions include hybridization at 70° C. in 1×SSC or 50° C. in 1×SSC, 50% formamide followed by washing at 70° C. in 0.3×SSC or hybridization at 70° C. in 4×SSC or 50° C. in 4×SSC, 50% formamide followed by washing at 67° C. in 1×SSC. The hybridization temperature for hybrids anticipated to be less than 50 base pairs in length should be 5-10° C. less than the melting temperature (Tm) of the hybrid, where Tm is determined according to the following equations. For hybrids less than 18 base pairs in length, Tm(° C.)=2 (# of A+T bases)+4 (# of G+C bases). For hybrids between 18 and 49 base pairs in length, Tm(° C.)=81.5+16.6 (log 10[Na+])+0.41 (% G+C)−(600/N), where N is the number of bases in the hybrid, and [Na+] is the concentration of sodium ions in the hybridization buffer ([Na+] for 1×SSC=0.165 M). Additional examples of stringency conditions for polynucleotide hybridization are provided in Sambrook, J., E. F. Fritsch, and T. Maniatis, 1989, Molecular Cloning: A Laboratory Manual, Cold Spring Harbor Laboratory Press, Cold Spring Harbor, N.Y., chapters 9 and 11, and Current Protocols in Molecular Biology, 1995, F. M. Ausubel et al., eds., John Wiley & Sons, Inc., sections 2.10 and 6.3-6.4. The length of the identical nucleotide sequences may be at least 10, 12, 15, 17, 20, 22, 25, 27 or 30 bases.

By "conserved sequence region" is meant, a nucleotide sequence of one or more regions in a polynucleotide does not vary significantly between generations or from one biological system, subject, or organism to another biological system, subject, or organism. The polynucleotide can include both coding and non-coding DNA and RNA.

By "sense region" is meant a nucleotide sequence of a dsRNA molecule having complementarity to an antisense region of the dsRNA molecule. In addition, the sense region of a dsRNA molecule can comprise a nucleic acid sequence having homology with a target nucleic acid sequence.

By "antisense region" is meant a nucleotide sequence of a dsRNA molecule having complementarity to a target nucleic acid sequence. In addition, the antisense region of a dsRNA molecule comprises a nucleic acid sequence having complementarity to a sense region of the dsRNA molecule.

As used herein, "antisense strand" refers to a single stranded nucleic acid molecule which has a sequence complementary to that of a target RNA. When the antisense strand contains modified nucleotides with base analogs, it is not necessarily complementary over its entire length, but must at least hybridize with a target RNA.

As used herein, "sense strand" refers to a single stranded nucleic acid molecule which has a sequence complementary to that of an antisense strand. When the antisense strand contains modified nucleotides with base analogs, the sense strand need not be complementary over the entire length of the antisense strand, but must at least duplex with the antisense strand.

As used herein, "guide strand" refers to a single stranded nucleic acid molecule of a dsRNA or dsRNA-containing molecule, which has a sequence sufficiently complementary to that of a target RNA to result in RNA interference. After cleavage of the dsRNA or dsRNA-containing molecule by Dicer, a fragment of the guide strand remains associated with RISC, binds a target RNA as a component of the RISC complex, and promotes cleavage of a target RNA by RISC. As used herein, the guide strand does not necessarily refer to a continuous single stranded nucleic acid and may comprise a discontinuity, preferably at a site that is cleaved by Dicer. A guide strand is an antisense strand.

As used herein, "passenger strand" refers to an oligonucleotide strand of a dsRNA or dsRNA-containing molecule, which has a sequence that is complementary to that of the guide strand. As used herein, the passenger strand does not necessarily refer to a continuous single stranded nucleic acid and may comprise a discontinuity, preferably at a site that is cleaved by Dicer. A passenger strand is a sense strand.

By "target nucleic acid" is meant a nucleic acid sequence whose expression, level or activity is to be modulated. The target nucleic acid can be DNA or RNA. For agents that target α-1 antitrypsin, in certain embodiments, the target nucleic acid is α-1 antitrypsin RNA, e.g., in certain embodiments, α-1 antitrypsin mRNA. α-1 antitrypsin RNA target sites can also interchangeably be referenced by corresponding cDNA sequences. Levels of α-1 antitrypsin may also be targeted via targeting of upstream effectors of α-1 antitrypsin, or the effects of modulated or misregulated α-1 antitrypsin may also be modulated by targeting of molecules downstream of α-1 antitrypsin in the α-1 antitrypsin signalling pathway.

By "complementarity" is meant that a nucleic acid can form hydrogen bond(s) with another nucleic acid sequence by either traditional Watson-Crick or other non-traditional types. In reference to the nucleic molecules of the present invention, the binding free energy for a nucleic acid molecule with its complementary sequence is sufficient to allow the relevant function of the nucleic acid to proceed, e.g., RNAi activity. Determination of binding free energies for nucleic acid molecules is well known in the art (see, e.g., Turner et al., 1987, CSH Symp. Quant. Biol. LII pp. 123-133; Frier et al., 1986, Proc. Nat. Acad. Sci. USA 83:9373-9377; Turner et al., 1987, J. Am. Chem. Soc. 109:3783-3785). A percent complementarity indicates the percentage of contiguous residues in a nucleic acid molecule that can form hydrogen bonds (e.g., Watson-Crick base pairing) with a second nucleic acid sequence (e.g., 5, 6, 7, 8, 9, or 10 nucleotides out of a total of 10 nucleotides in the first oligonucleotide being based paired to a second nucleic acid sequence having 10 nucleotides represents 50%, 60%, 70%, 80%, 90%, and 100% complementary respectively). "Perfectly complementary" means that all the contiguous residues of a nucleic acid sequence will hydrogen bond with the same number of contiguous residues in a second nucleic acid sequence. In one embodiment, a dsRNA molecule of the invention comprises 19 to 30 (e.g., 19, 20, 21, 22, 23, 24, 25, 26, 27, 28, 29, or 30 or more) nucleotides that are complementary to one or more target nucleic acid molecules or a portion thereof.

As used herein, a dsRNA, e.g., DsiRNA or siRNA, having a sequence "sufficiently complementary" to a target RNA or cDNA sequence (e.g., α-1 antitrypsin mRNA) means that the dsRNA has a sequence sufficient to trigger the destruction of the target RNA (where a cDNA sequence is recited, the RNA sequence corresponding to the recited cDNA sequence) by the RNAi machinery (e.g., the RISC complex) or process. For example, a dsRNA that is "sufficiently complementary" to a target RNA or cDNA sequence to trigger the destruction of the target RNA by the RNAi machinery or process can be identified as a dsRNA that causes a detectable reduction in the level of the target RNA in an appropriate assay of dsRNA activity (e.g., an in vitro assay as described in Example 2 below), or, in further examples, a dsRNA that is sufficiently complementary to a target RNA or cDNA sequence to trigger the destruction of the target RNA by the RNAi machinery or process can be identified as a dsRNA that produces at least a 5%, at least a 10%, at least a 15%, at least a 20%, at least a 25%, at least a 30%, at least a 35%, at least a 40%, at least a 45%, at least a 50%, at least a 55%, at least a 60%, at least a 65%, at least a 70%, at least a 75%, at least a 80%, at least a 85%, at least a 90%, at least a 95%, at least a 98% or at least a 99% reduction in the level of the target RNA in an appropriate assay of dsRNA activity. In additional examples, a dsRNA that is sufficiently complementary to a target RNA or cDNA sequence to trigger the destruction of the target RNA by the RNAi machinery or process can be identified based upon assessment of the duration of a certain level of inhibitory activity with respect to the target RNA or protein levels in a cell or organism. For example, a dsRNA that is sufficiently complementary to a target RNA or cDNA sequence to trigger the destruction of the target RNA by the RNAi machinery or process can be identified as a dsRNA capable of reducing target mRNA levels by at least 20% at least 48 hours post-administration of said dsRNA to a cell or organism. Preferably, a dsRNA that is sufficiently complementary to a target RNA or cDNA sequence to trigger the destruction of the target RNA by the RNAi machinery or process is identified as a dsRNA capable of reducing target mRNA levels by at least 40% at least 72 hours post-administration of said dsRNA to a cell or organism, by at least 40% at least four, five or seven days post-administration of said dsRNA to a cell or organism, by at least 50% at least 48 hours post-administration of said dsRNA to a cell or organism, by at least 50% at least 72 hours post-administration of said dsRNA to a cell or organism, by at least 50% at least four, five or seven days post-administration of said dsRNA to a cell or organism, by at least 80% at least 48 hours post-administration of said dsRNA to a cell or organism, by at least 80% at least 72 hours post-administration of said dsRNA to a cell or organism, or by at least 80% at least four, five or seven days post-administration of said dsRNA to a cell or organism.

In certain embodiments, a nucleic acid of the invention (e.g., a DsiRNA or siRNA) possesses a sequence "sufficiently complementary to hybridize" to a target RNA or cDNA sequence, thereby achieving an inhibitory effect upon the target RNA. Hybridization, and conditions available for determining whether one nucleic acid is sufficiently complementary to another nucleic acid to allow the two sequences to hybridize, is described in greater detail below.

As used herein "cell" is used in its usual biological sense, and does not refer to an entire multicellular organism, e.g., specifically does not refer to a human. The cell can be present in an organism, e.g., birds, plants and mammals such as humans, cows, sheep, apes, monkeys, swine, dogs, and cats. The cell can be prokaryotic (e.g., bacterial cell) or eukaryotic (e.g., mammalian or plant cell). The cell can be of somatic or germ line origin, totipotent or pluripotent, dividing or non-dividing. The cell can also be derived from or can comprise a gamete or embryo, a stem cell, or a fully differentiated cell. Within certain aspects, the term "cell" refers specifically to mammalian cells, such as human cells, that contain one or more dsRNA molecules of the present disclosure. In particular aspects, a cell processes dsRNAs or dsRNA-containing molecules resulting in RNA interference of target nucleic acids, and contains proteins and protein complexes required for RNAi, e.g., Dicer and RISC.

By "RNA" is meant a molecule comprising at least one, and preferably at least 4, 8 and 12 ribonucleotide residues. The at least 4, 8 or 12 RNA residues may be contiguous. By "ribonucleotide" is meant a nucleotide with a hydroxyl group at the 2' position of a β-D-ribofuranose moiety. The terms include double-stranded RNA, single-stranded RNA, RNA such as partially purified RNA, essentially pure RNA, synthetic RNA, recombinantly produced RNA, as well as altered RNA that differs from naturally occurring RNA by the addition, deletion, substitution and/or alteration of one or more nucleotides. Such alterations can include addition of non-nucleotide material, such as to the end(s) of the dsRNA or internally, for example at one or more nucleotides of the RNA. Nucleotides in the RNA molecules of the instant invention can also comprise non-standard nucleotides, such as non-naturally occurring nucleotides or chemically synthesized nucleotides or deoxynucleotides. These altered RNAs can be referred to as analogs or analogs of naturally-occurring RNA.

In certain embodiments, an RNAi agent (e.g., dsRNA) of the invention can be an "isolated" RNAi agent, meaning that the RNAi agent is isolated from (removed and/or purified from) a natural environment.

In some embodiments, an RNAi agent (e.g., dsRNA) of the invention can be a "synthetic" RNAi agent. The term "synthetic" or "non-natural" refers to an RNAi agent (e.g., a dsRNA of the disclosure) that (i) is synthesized using a machine or (ii) that is not derived from a cell or organism that normally produces the RNAi agent.

By "subject" is meant an organism, which is a donor or recipient of explanted cells or the cells themselves. "Subject" also refers to an organism to which the dsRNA agents of the invention can be administered. A subject can be a mammal or mammalian cells, including a human or human cells.

The phrase "pharmaceutically acceptable carrier" refers to a carrier for the administration of a therapeutic agent. Exemplary carriers include saline, buffered saline, dextrose, water, glycerol, ethanol, and combinations thereof. For drugs administered orally, pharmaceutically acceptable carriers include, but are not limited to pharmaceutically acceptable excipients such as inert diluents, disintegrating agents, binding agents, lubricating agents, sweetening agents, flavoring agents, coloring agents and preservatives. Suitable inert diluents include sodium and calcium carbonate, sodium and calcium phosphate, and lactose, while corn starch and alginic acid are suitable disintegrating agents. Binding agents may include starch and gelatin, while the lubricating agent, if present, will generally be magnesium stearate, stearic acid or talc. If desired, the tablets may be coated with a material such as glyceryl monostearate or glyceryl distearate, to delay absorption in the gastrointestinal tract. The pharmaceutically acceptable carrier of the disclosed dsRNA compositions may be micellar structures, such as a liposomes, capsids, capsoids, polymeric nanocapsules, or polymeric microcapsules.

Polymeric nanocapsules or microcapsules facilitate transport and release of the encapsulated or bound dsRNA into the cell. They include polymeric and monomeric materials, especially including polybutylcyanoacrylate. A summary of materials and fabrication methods has been published (see Kreuter, 1991). The polymeric materials which are formed from monomeric and/or oligomeric precursors in the polymerization/nanoparticle generation step, are per se known from the prior art, as are the molecular weights and molecular weight distribution of the polymeric material which a person skilled in the field of manufacturing nanoparticles may suitably select in accordance with the usual skill.

The term "in vitro" has its art recognized meaning, e.g., involving purified reagents or extracts, e.g., cell extracts. The term "in vivo" also has its art recognized meaning, e.g., involving living cells, e.g., immortalized cells, primary cells, cell lines, and/or cells in an organism.

"Treatment", or "treating" as used herein, is defined as the application or administration of a therapeutic agent (e.g., a dsRNA agent or a vector or transgene encoding same) to a patient, or application or administration of a therapeutic agent to an isolated tissue or cell line from a patient, who has a disorder with the purpose to cure, heal, alleviate, relieve, alter, remedy, ameliorate, improve or affect the disease or disorder, or symptoms of the disease or disorder. The term "treatment" or "treating" is also used herein in the context of administering agents prophylactically. The term "effective dose" or "effective dosage" is defined as an amount sufficient to achieve or at least partially achieve the desired effect. The term "therapeutically effective dose" is defined as an amount sufficient to cure or at least partially arrest the disease and its complications in a patient already suffering from the disease. The term "patient" includes human and other mammalian subjects that receive either prophylactic or therapeutic treatment.

Various methodologies of the instant invention include at least one step that involves comparing a value, level, feature, characteristic, property, etc. to a "suitable control", referred to interchangeably herein as an "appropriate control". A "suitable control" or "appropriate control" is a control or standard familiar to one of ordinary skill in the art useful for comparison purposes. In one embodiment, a "suitable control" or "appropriate control" is a value, level, feature, characteristic, property, etc. determined prior to performing an RNAi methodology, as described herein. For example, a transcription rate, mRNA level, translation rate, protein level, biological activity, cellular characteristic or property, genotype, phenotype, etc. can be determined prior to introducing an RNA silencing agent (e.g., DsiRNA) of the invention into a cell or organism. In another embodiment, a "suitable control" or "appropriate control" is a value, level, feature, characteristic, property, etc. determined in a cell or organism, e.g., a control or normal cell or organism, exhibiting, for example, normal traits. In yet another embodiment, a "suitable control" or "appropriate control" is a predefined value, level, feature, characteristic, property, etc.

α-1 Antitrypsin as an RNAi Target

Alpha 1-antitrypsin (AAT or Serpina1) is a protease inhibitor belonging to the serpin superfamily. It is generally known as serum trypsin inhibitor. Alpha 1-antitrypsin is also referred to as alpha-1 proteinase inhibitor (A1PI) because it inhibits a wide variety of proteases (Gettins P G. Chem Rev 102: 4751-804). It protects tissues from enzymes of inflammatory cells, especially neutrophil elastase, and has a reference range in blood of 1.5-3.5 gram/liter, but multi-fold elevated levels can occur upon acute inflammation (Kushner, Mackiewicz. Acute-phase glycoproteins: molecular biology, biochemistry and clinical applications (CRC Press). pp. 3-19). In the absence of AAT, neutrophil elastase is free to break down elastin, which contributes to the elasticity of the lungs, resulting in respiratory complications such as emphysema, or COPD (chronic obstructive pulmonary disease) in adults and cirrhosis in adults or children. Individuals with mutations in one or both copies of the AAT gene can suffer from alpha-1 anti-trypsin deficiency, which presents as a risk of developing pulmonary emphysema or chronic liver disease due to greater than normal elastase activity in the lungs and liver.

As mentioned above, in certain disease states associated with α-1 antitrypsin expression, an individual is producing significant quantities of alpha-1 antitrypsin, but a significant proportion of the α-1 antitrypsin protein being produced is misfolded or contains mutations that compromise the functioning of the protein. In certain such cases, the individual is producing misfolded proteins which cannot be properly transported from the site of synthesis to the site of action within the body.

Liver disease resulting from α-1 antitrypsin deficiency can be caused by such misfolded proteins. Mutant forms of α-1 antitrypsin (e.g., the common PiZ variant, which harbors a glutamate to lysine mutation at position 342 (position 366 in pre-processed form)) are produced in liver cells (hepatocytes in the liver commonly produce a large amount of circulating AAT), and in the misfolded configuration, such forms are not readily transported out of the cells. This leads to a buildup of misfolded protein in the liver cells and can cause one or more diseases or disorders of the liver including, but not limited to, chronic liver disease, liver inflammation, cirrhosis, liver fibrosis, and/or hepatocellular carcinoma.

RNAi therapies are newly identified to provide an attractive, targeted means of treating the effects of mutant forms of α-1 antitrypsin at a molecular level. Notably, RNAi therapies, such as the dsRNAs that are specifically exemplified herein, have demonstrated particularly good ability to be delivered to the cells of the liver in vivo (via, e.g., lipid nanoparticles and/or conjugates such as dynamic polyconjugates or GalNAc conjugates). Thus, formulated RNAi therapies, such as those described herein, are attractive modalities for treating or preventing diseases or disorders (especially the liver-specific diseases or disorders, e.g., chronic liver disease, liver inflammation, cirrhosis, liver fibrosis, and/or hepatocellular carcinoma) associated with mutant forms of α-1 antitrypsin.

Use of RNAi therapies to target α-1 antitrypsin at a molecular level in other tissues is also contemplated. Most notably, in the lung, the presence of mutant, inactive forms of α-1 antitrypsin in the serum can cause a deficiency in serum levels of active α-1 antitrypsin, resulting in host tissues that are susceptible to damage by neutrophil proteases. As a result, such lung tissues are rendered especially at risk of smoking injury, and lung-directed RNAi therapeutics such as those described herein offer an attractive and precise therapy.

α-1 Antitrypsin cDNA and Polypeptide Sequences

Known human and mouse α-1 antitrypsin cDNA and polypeptide sequences include the following: human α-1 antitrypsin NM_000295.4 and corresponding human α-1 antitrypsin polypeptide sequence GenBank Accession No. NP_000286.3; and mouse wild-type α-1 antitrypsin sequence GenBank Accession No. NM_009246.3 (*Mus musculus* C57BL/6 Serpina1d) and corresponding mouse Serpina1d sequence GenBank Accession No. NP_033272.1.

Assessment of α-1 Antitrypsin Levels

In certain embodiments, dsRNA-mediated inhibition of a α-1 antitrypsin target sequence is assessed. In such embodiments, α-1 antitrypsin RNA levels can be assessed by art-recognized methods (e.g., RT-PCR, Northern blot, expression array, etc.), optionally via comparison of α-1 antitrypsin levels in the presence of an anti-α-1 antitrypsin dsRNA of the invention relative to the absence of such an anti-α-1 antitrypsin dsRNA. In certain embodiments, α-1 antitrypsin levels in the presence of an anti-α-1 antitrypsin dsRNA are compared to those observed in the presence of vehicle alone, in the presence of a dsRNA directed against an unrelated target RNA, or in the absence of any treatment.

It is also recognized that levels of α-1 antitrypsin protein can be assessed and that α-1 antitrypsin protein levels are, under different conditions, either directly or indirectly related to α-1 antitrypsin RNA levels and/or the extent to which a dsRNA inhibits α-1 antitrypsin expression, thus art-recognized methods of assessing α-1 antitrypsin protein levels (e.g., Western blot, immunoprecipitation, other antibody-based methods, etc.) can also be employed to examine the inhibitory effect of a dsRNA of the invention.

In certain embodiments, potency of a dsRNA of the invention is determined in reference to the number of copies of a dsRNA present in the cytoplasm of a target cell that are required to achieve a certain level of target gene knockdown. For example, in certain embodiments, a potent dsRNA is one capable of causing 50% or greater knockdown of a target mRNA when present in the cytoplasm of a target cell at a copy number of 1000 or fewer RISC-loaded antisense strands per cell. More preferably, a potent dsRNA is one capable of producing 50% or greater knockdown of a target mRNA when present in the cytoplasm of a target cell at a copy number of 500 or fewer RISC-loaded antisense strands per cell. Optionally, a potent dsRNA is one capable of producing 50% or greater knockdown of a target mRNA when present in the cytoplasm of a target cell at a copy number of 300 or fewer RISC-loaded antisense strands per cell.

In further embodiments, the potency of a DsiRNA of the invention can be defined in reference to a 19 to 23mer dsRNA directed to the same target sequence within the same target gene. For example, a DsiRNA of the invention that possesses enhanced potency relative to a corresponding 19 to 23mer dsRNA can be a DsiRNA that reduces a target gene by an additional 5% or more, an additional 10% or more, an additional 20% or more, an additional 30% or more, an additional 40% or more, or an additional 50% or more as compared to a corresponding 19 to 23mer dsRNA, when assayed in an in vitro assay as described herein at a sufficiently low concentration to allow for detection of a potency difference (e.g., transfection concentrations at or below 1 nM in the environment of a cell, at or below 100 pM in the environment of a cell, at or below 10 pM in the environment of a cell, at or below 1 nM in the environment of a cell, in an in vitro assay as described herein; notably, it is recognized that potency differences can be best detected via performance of such assays across a range of concentrations—e.g., 0.1 pM to 10 nM—for purpose of generating a dose-response curve and identifying an $IC_{50}$ value associated with a DsiRNA/dsRNA).

In certain embodiments, a nucleic acid of the invention is administered in an amount sufficient to reduce α-1 antitrypsin target mRNA expression when the nucleic acid is introduced into a mammalian cell. In exemplary embodiments, reduction of α-1 antitrypsin target mRNA expression is assessed to have occurred if α-1 antitrypsin target mRNA levels are decreased by at least 5% or more, 10% or more, 20% or more, 30% or more, 40% or more, 50% or more, 60% or more, 70% or more, 80% or more, or 90% or more, as compared to a corresponding mammalian cell administered an appropriate control that does not include the α-1 antitrypsin-targeting nucleic acid of the invention. In an exemplary embodiment, the mammalian cell used to determine whether reduction of α-1 antitrypsin target mRNA expression has occurred relative to an appropriate control is a Huh7 cell, and the α-1 antitrypsin-targeting nucleic acid of the invention is optionally administered via transfection (e.g., using Lipofectamine™) at a concentration of at or below 1 nM in the environment of a cell, at or below 100 pM in the environment of a cell, at or below 10 pM in the environment of a cell, at or below 1 nM in the environment of a cell, in an in vitro assay as described herein.

α-1 antitrypsin inhibitory levels and/or α-1 antitrypsin levels may also be assessed indirectly, e.g., measurement of a reduction of the size, number and/or rate of growth or spread of polyps or tumors in a subject may be used to assess α-1 antitrypsin levels and/or α-1 antitrypsin inhibitory efficacy of a double-stranded nucleic acid of the instant invention.

Models Useful to Evaluate the Down-Regulation of α-1 Antitrypsin mRNA Levels and Expression Therapeutic agents can be tested in selected animal model(s). For example, a dsRNA agent (or expression vector or transgene encoding same) as described herein can be used in an animal model to determine the efficacy, toxicity, or side effects of treatment with said agent. Alternatively, an agent (e.g., a therapeutic agent) can be used in an animal model to determine the mechanism of action of such an agent.

Cell Culture

The dsRNA agents of the invention can be tested for cleavage activity in vivo, for example, using the following procedure. The nucleotide sequences within the α-1 antitrypsin cDNA targeted by the dsRNA agents of the invention are shown in the above α-1 antitrypsin sequences.

The dsRNA reagents of the invention can be tested in cell culture using Huh7 or other mammalian cells (e.g., human cell lines Hep3B, HepG2, DU145, Calu3, SW480, T84, PL45, HeLa etc., and mouse cell lines AML12, Neuro2a, etc.) to determine the extent of α-1 antitrypsin RNA and α-1 antitrypsin protein inhibition. In certain embodiments, DsiRNA reagents (e.g., see FIG. 1, and exemplary structures recited elsewhere herein) are selected against the α-1 antitrypsin target as described herein. α-1 antitrypsin RNA inhibition is measured after delivery of these reagents by a suitable transfection agent to, for example, cultured Huh7 cells or other transformed or non-transformed mammalian cells in culture. Relative amounts of target α-1 antitrypsin RNA are measured versus HPRT1, actin or other appropriate control using real-time PCR monitoring of amplification (e.g., ABI 7700 TAQMAN®). A comparison is made to the activity of oligonucleotide sequences made to unrelated targets or to a randomized DsiRNA control with the same overall length and chemistry, or simply to appropriate vehicle-treated or untreated controls. Primary and secondary lead reagents are chosen for the target and optimization performed.

TAQMAN® (Real-Time PCR Monitoring of Amplification) and Lightcycler Quantification of mRNA Total RNA is prepared from cells following DsiRNA delivery, for example, using Ambion Rnaqueous 4-PCR purification kit for large scale extractions, or Promega SV96 for 96-well assays. For Taqman analysis, dual-labeled probes are synthesized with, for example, the reporter dyes FAM or VIC covalently linked at the 5'-end and the quencher dye TAMRA conjugated to the 3'-end. PCR amplifications are performed on, for example, an ABI PRISM 7700 Sequence detector using 50 uL reactions consisting of 10 uL total RNA, 100 nM forward primer, 100 mM reverse primer, 100 nM probe, 1× TaqMan PCR reaction buffer (PE-Applied Biosystems), 5.5 mM MgCl2, 100 uM each dATP, dCTP, dGTP and dTTP, 0.2 U RNase Inhibitor (Promega), 0.025 U AmpliTaq Gold (PE-Applied Biosystems) and 0.2 U M-MLV Reverse Transcriptase (Promega). The thermal cycling conditions can consist of 30 minutes at 48° C., 10 minutes at 95° C., followed by 40 cycles of 15 seconds at 95° C. and 1 minute at 60° C. Quantitation of target α-1 antitrypsin mRNA level is determined relative to standards generated from serially diluted total cellular RNA (300, 100, 30, 10 ng/rxn) and normalizing to, for example, HPRT1 mRNA in either parallel or same tube TaqMan reactions.

Western Blotting

Cellular protein extracts can be prepared using a standard micro preparation technique (for example using RIPA buffer), or preferably, by extracting nuclear proteins by a method such as the NE-PER Nuclear and Cytoplasmic Extraction kit (Thermo-Fisher Scientific). Cellular protein extracts are run on Tris-Glycine polyacrylamide gel and transferred onto membranes. Non-specific binding can be blocked by incubation, for example, with 5% non-fat milk for 1 hour followed by primary antibody for 16 hours at 4° C. Following washes, the secondary antibody is applied, for example (1:10,000 dilution) for 1 hour at room temperature and the signal detected on a VersaDoc imaging system In several cell culture systems, cationic lipids have been shown to enhance the bioavailability of oligonucleotides to cells in culture (Bennet, et al., 1992, Mol. Pharmacology, 41, 1023-1033). In one embodiment, dsRNA molecules of the invention are complexed with cationic lipids for cell culture experiments. dsRNA and cationic lipid mixtures are prepared in serum-free OptimMEM (InVitrogen) immediately prior to addition to the cells. OptiMEM is warmed to room temperature (about 20-25° C.) and cationic lipid is added to the final desired concentration. dsRNA molecules are added to OptiMEM to the desired concentration and the solution is added to the diluted dsRNA and incubated for 15 minutes at room temperature. In dose response experiments, the RNA complex is serially diluted into OptiMEM prior to addition of the cationic lipid.

Animal Models

The efficacy of anti-α-1 antitrypsin dsRNA agents may be evaluated in an animal model. Animal models of liver diseases, conditions, or disorders as are known in the art can be used for evaluation of the efficacy, potency, toxicity, etc. of anti-α-1 antitrypsin dsRNAs. Exemplary animals model of α-1 antitrypsin-induced liver disease are transgenic mice that express human α-1 antitrypsin mutant Z protein, PiZ, which recapitulate the human liver disease and exhibit inflammation, increased levels of apoptosis and autophagy, accelerated proliferation and enhanced development of hepatic progenitor cells (the behavior of such models also suggest the employment of antioxidants in combination with anti-α-1 antitrypsin dsRNAs in treatment of liver disease; Marcus et al. *Exper Biol Med* 237: 1163-1172; Teckman et al. *Am J Physiol Gastrointest Liver Physiol* 286: G851-62; Rudnick et al. *Hepatology* 39: 1048-55; Brunt et al. *J Pediatr Gastroenterol Nutr* 51: 626-30). Such mice are available, for example, from Saint Louis University. These animal models may be used as a source cells or tissue for assays of the compositions of the invention. Such models can also be used or adapted for use for pre-clinical evaluation of the efficacy of dsRNA compositions of the invention in modulating α-1 antitrypsin gene expression toward therapeutic use.

Such models and/or wild-type mice can be used in evaluating the efficacy of dsRNA molecules of the invention to inhibit α-1 antitrypsin levels, expression, development of α-1 antitrypsin-associated phenotypes, diseases or disorders, etc. These models, wild-type mice and/or other models can similarly be used to evaluate the safety/toxicity and efficacy of dsRNA molecules of the invention in a pre-clinical setting.

Specific examples of animal model systems useful for evaluation of the α-1 antitrypsin-targeting dsRNAs of the invention include wild-type mice and transgenic PiZ mutant model mice. In an exemplary in vivo experiment, dsRNAs of the invention are tail vein injected into such mouse models at doses ranging from 1 to 10 mg/kg or, alternatively, repeated doses are administered at single-dose $IC_{50}$ levels, and organ samples (e.g., liver, but may also include prostate, kidney, lung, pancreas, colon, skin, spleen, bone marrow, lymph nodes, mammary fat pad, etc.) are harvested 24 hours after administration of the final dose. Such organs are then evaluated for mouse and/or human α-1 antitrypsin levels, depending upon the model used. Duration of action can also be examined at, e.g., 1, 4, 7, 14, 21 or more days after final dsRNA administration.

α-1 Antitrypsin-Targeting dsRNAs

In certain embodiments, an anti-α-1 antitrypsin DsiRNA of the instant invention possesses strand lengths of at least 25 nucleotides. Accordingly, in certain embodiments, an anti-α-1 antitrypsin DsiRNA contains one oligonucleotide sequence, a first sequence, that is at least 25 nucleotides in length and no longer than 35 or up to 50 or more nucleotides. This sequence of RNA can be between 26 and 35, 26 and 34, 26 and 33, 26 and 32, 26 and 31, 26 and 30, and 26 and 29 nucleotides in length. This sequence can be 27 or 28 nucleotides in length or 27 nucleotides in length. The second sequence of the DsiRNA agent can be a sequence that anneals to the first sequence under biological conditions, such as within the cytoplasm of a eukaryotic cell. Generally, the second oligonucleotide sequence will have at least 19 complementary base pairs with the first oligonucleotide sequence, more typically the second oligonucleotide sequence will have 21 or more complementary base pairs, or 25 or more complementary base pairs with the first oligonucleotide sequence. In one embodiment, the second sequence is the same length as the first sequence, and the DsiRNA agent is blunt ended. In another embodiment, the ends of the DsiRNA agent have one or more overhangs.

In certain embodiments, the first and second oligonucleotide sequences of the DsiRNA agent exist on separate oligonucleotide strands that can be and typically are chemically synthesized. In some embodiments, both strands are between 26 and 35 nucleotides in length. In other embodiments, both strands are between 25 and 30 or 26 and 30 nucleotides in length. In one embodiment, both strands are 27 nucleotides in length, are completely complementary and have blunt ends. In certain embodiments of the instant invention, the first and second sequences of an anti-α-1 antitrypsin DsiRNA exist on separate RNA oligonucleotides (strands). In one embodiment, one or both oligonucleotide strands are capable of serving as a substrate for Dicer. In other embodiments, at least one modification is present that promotes Dicer to bind to the double-stranded RNA structure in an orientation that maximizes the double-stranded RNA structure's effectiveness in inhibiting gene expression. In certain embodiments of the instant invention, the anti-α-1 antitrypsin DsiRNA agent is comprised of two oligonucleotide strands of differing lengths, with the anti-α-1 antitrypsin DsiRNA possessing a blunt end at the 3' terminus of a first strand (sense strand) and a 3' overhang at the 3' terminus of a second strand (antisense strand). The DsiRNA can also contain one or more deoxyribonucleic acid (DNA) base substitutions.

Suitable DsiRNA compositions that contain two separate oligonucleotides can be chemically linked outside their annealing region by chemical linking groups. Many suitable chemical linking groups are known in the art and can be used. Suitable groups will not block Dicer activity on the DsiRNA and will not interfere with the directed destruction of the RNA transcribed from the target gene. Alternatively, the two separate oligonucleotides can be linked by a third oligonucleotide such that a hairpin structure is produced upon annealing of the two oligonucleotides making up the DsiRNA composition. The hairpin structure will not block Dicer activity on the DsiRNA and will not interfere with the directed destruction of the target RNA.

The dsRNA molecule can be designed such that every residue of the antisense strand is complementary to a residue in the target molecule. Alternatively, substitutions can be made within the molecule to increase stability and/or enhance processing activity of said molecule. Substitutions can be made within the strand or can be made to residues at the ends of the strand. In certain embodiments, substitutions and/or modifications are made at specific residues within a DsiRNA agent. Such substitutions and/or modifications can include, e.g., deoxy-modifications at one or more residues of positions 1, 2 and 3 when numbering from the 3' terminal position of the sense strand of a DsiRNA agent; and introduction of 2'-O-alkyl (e.g., 2'-O-methyl) modifications at the 3' terminal residue of the antisense strand of DsiRNA agents, with such modifications also being performed at overhang positions of the 3' portion of the antisense strand and at alternating residues of the antisense strand of the DsiRNA that are included within the region of a DsiRNA agent that is processed to form an active siRNA agent. The preceding modifications are offered as exemplary, and are not intended to be limiting in any manner. Further consideration of the structure of preferred DsiRNA agents, including further description of the modifications and substitutions that can be performed upon the anti-α-1 antitrypsin DsiRNA agents of the instant invention, can be found below.

A dsRNA of the invention comprises two RNA strands that are sufficiently complementary to hybridize to form a duplex structure. One strand of the dsRNA (the antisense strand) comprises a region of complementarity that is substantially complementary, and generally fully complementary, to a target sequence, derived from the sequence of an mRNA formed during the expression of the α-1 antitrypsin target gene, the other strand (the sense strand) comprises a region which is complementary to the antisense strand, such that the two strands hybridize and form a duplex structure when combined under suitable conditions. Generally, the duplex structure is between 15 and 35, optionally between 25 and 30, between 26 and 30, between 18 and 25, between 19 and 24, or between 19 and 21 base pairs in length. Similarly, the region of complementarity to the target sequence is between 15 and 35, optionally between 18 and 30, between 25 and 30, between 19 and 24, or between 19 and 21 nucleotides in length. The dsRNA of the invention may further comprise one or more single-stranded nucleotide overhang(s). It has been identified that dsRNAs comprising duplex structures of between 15 and 35 base pairs in length can be effective in inducing RNA interference, including DsiRNAs (generally of at least 25 base pairs in length) and siRNAs (in certain embodiments, duplex structures of siRNAs are between 20 and 23, and optionally, specifically 21 base pairs (Elbashir et al., *EMBO* 20: 6877-

6888)). It has also been identified that dsRNAs possessing duplexes shorter than 20 base pairs can be effective as well (e.g., 15, 16, 17, 18 or 19 base pair duplexes). In certain embodiments, the dsRNAs of the invention can comprise at least one strand of a length of 19 nucleotides or more. In certain embodiments, it can be reasonably expected that shorter dsRNAs comprising a sequence complementary to one of the sequences of Tables 5, 10, 15 or 20, minus only a few nucleotides on one or both ends may be similarly effective as compared to the dsRNAs described above and in Tables 2-3, 7-8, 12-13 and 17-18. Hence, dsRNAs comprising a partial sequence of at least 15, 16, 17, 18, 19, 20, or more contiguous nucleotides sufficiently complementary to one of the sequences of Tables 5, 10, 15 or 20, and differing in their ability to inhibit the expression of the α-1 antitrypsin target gene in an assay as described herein by not more than 5, 10, 15, 20, 25, or 30% inhibition from a dsRNA comprising the full sequence, are contemplated by the invention. In one embodiment, at least one end of the dsRNA has a single-stranded nucleotide overhang of 1 to 5, optionally 1 to 4, in certain embodiments, 1 or 2 nucleotides. Certain dsRNA structures having at least one nucleotide overhang possess superior inhibitory properties as compared to counterparts possessing base-paired blunt ends at both ends of the dsRNA molecule.

In one embodiment, dsRNA molecules of the invention that down regulate or reduce α-1 antitrypsin gene expression are used for treating, preventing or reducing α-1 antitrypsin-related diseases or disorders (e.g., liver disease) in a subject or organism.

In one embodiment of the present invention, each sequence of a DsiRNA molecule of the invention is independently 25 to 35 nucleotides in length, in specific embodiments 25, 26, 27, 28, 29, 30, 31, 32, 33, 34 or 35 nucleotides in length. In another embodiment, the DsiRNA duplexes of the invention independently comprise 25 to 30 base pairs (e.g., 25, 26, 27, 28, 29, or 30). In another embodiment, one or more strands of the DsiRNA molecule of the invention independently comprises 19 to 35 nucleotides (e.g., 19, 20, 21, 22, 23, 24, 25, 26, 27, 28, 29, 30, 31, 32, 33, 34 or 35) that are complementary to a target (α-1 antitrypsin) nucleic acid molecule. In certain embodiments, a DsiRNA molecule of the invention possesses a length of duplexed nucleotides between 25 and 34 nucleotides in length (e.g., 25, 26, 27, 28, 29, 30, 31, 32, 33 or 34 nucleotides in length; optionally, all such nucleotides base pair with cognate nucleotides of the opposite strand). (Exemplary DsiRNA molecules of the invention are shown in FIG. 1, and below).

In certain additional embodiments of the present invention, each oligonucleotide of a DsiRNA molecule of the invention is independently 25 to 53 nucleotides in length, in specific embodiments 25, 26, 27, 28, 29, 30, 31, 32, 33, 34, 35, 36, 37, 38, 39, 40, 41, 42, 43, 44, 45, 46, 47, 48, 49, 50, 51, 52 or 53 nucleotides in length. For DsiRNAs possessing a strand that exceeds 30 nucleotides in length, available structures include those where only one strand exceeds 30 nucleotides in length (see, e.g., U.S. Pat. No. 8,349,809), or those where both strands exceed 30 nucleotides in length (see, e.g., WO 2010/080129). Stabilizing modifications (e.g., 2'-O-Methyl, phosphorothioate, deoxyribonucleotides, including dNTP base pairs, etc.) can be incorporated within any double stranded nucleic acid of the invention, and can be used in particular within DsiRNAs possessing one or both strands exceeding 30 nucleotides in length. While the guide strand of a double stranded nucleic acid of the invention must possess a sequence of, e.g., 15, 16, 17, 18 or 19 nucleotides that are complementary to a target RNA (e.g., mRNA), additional sequence(s) of the guide strand need not be complementary to the target RNA. The end structures of double stranded nucleic acids possessing at least one strand length in excess of 30 nucleotides can also be varied while continuing to yield functional dsNAs—e.g. the 5' end of the guide strand and the 3' end of the passenger strand may form a 5'-overhang, a blunt end or a 3' overhang (for certain dsNAs, e.g., "single strand extended" dsNAs, the length of such a 5' or 3' overhang can be 1-4, 1-5, 1-6, 1-10, 1-15, 1-20 or even 1-25 or more); similarly, the 3' end of the guide strand and the 5' end of the passenger strand may form a 5'-overhang, a blunt end or a 3' overhang (for certain dsNAs, e.g., "single strand extended" dsNAs, the length of such a 5' or 3' overhang can be 1-4, 1-5, 1-6, 1-10, 1-15, 1-20 or even 1-25 or more). In certain embodiments, the length of the passenger strand is 31-49 nucleotides while the length of the guide strand is 31-53 nucleotides, optionally while the 5' end of the guide strand forms a blunt end (optionally, a base-paired blunt end) with the 3' end of the passenger strand, optionally, with the 3' end of the guide strand and the 5' end of the passenger strand forming a 3' overhang of 1-4 nucleotides in length. Exemplary "extended" Dicer substrate structures are set forth, e.g., in US 2010/0173974 and U.S. Pat. No. 8,349,809, both of which are incorporated herein by reference. In certain embodiments, one or more strands of the dsNA molecule of the invention independently comprises 19 to 35 nucleotides (e.g., 19, 20, 21, 22, 23, 24, 25, 26, 27, 28, 29, 30, 31, 32, 33, 34 or 35) that are complementary to a target (α-1 antitrypsin) nucleic acid molecule. In certain embodiments, a DsiRNA molecule of the invention possesses a length of duplexed nucleotides between 25 and 49 nucleotides in length (e.g., 25, 26, 27, 28, 29, 30, 31, 32, 33, 34, 35, 36, 37, 38, 39, 40, 41, 42, 43, 44, 45, 46, 47, 48 or 49 nucleotides in length; optionally, all such nucleotides base pair with cognate nucleotides of the opposite strand).

In certain embodiments, a DsiRNA (in a state as initially formed, prior to dicer cleavage) is more potent at reducing α-1 antitrypsin target gene expression in a mammalian cell than a 19, 20, 21, 22 or 23 base pair sequence that is contained within it. In certain such embodiments, a DsiRNA prior to dicer cleavage is more potent than a 19-21mer contained within it. Optionally, a DsiRNA prior to dicer cleavage is more potent than a 19 base pair duplex contained within it that is synthesized with symmetric dTdT overhangs (thereby forming a siRNA possessing 21 nucleotide strand lengths having dTdT overhangs). In certain embodiments, the DsiRNA is more potent than a 19-23mer siRNA (e.g., a 19 base pair duplex with dTdT overhangs) that targets at least 19 nucleotides of the 21 nucleotide target sequence that is recited for a DsiRNA of the invention (without wishing to be bound by theory, the identity of a such a target site for a DsiRNA is identified via identification of the Ago2 cleavage site for the DsiRNA; once the Ago2 cleavage site of a DsiRNA is determined for a DsiRNA, identification of the Ago2 cleavage site for any other inhibitory dsRNA can be performed and these Ago2 cleavage sites can be aligned, thereby determining the alignment of projected target nucleotide sequences for multiple dsRNAs). In certain related embodiments, the DsiRNA is more potent than a 19-23mer siRNA that targets at least 20 nucleotides of the 21 nucleotide target sequence that is recited for a DsiRNA of the invention. Optionally, the DsiRNA is more potent than a 19-23mer siRNA that targets the same 21 nucleotide target sequence that is recited for a DsiRNA of the invention. In certain embodiments, the DsiRNA is more potent than any 21mer siRNA that targets the same 21 nucleotide target sequence that is recited for a DsiRNA of the invention. Optionally, the DsiRNA is more potent than any 21 or 22mer siRNA that targets the same 21 nucleotide target sequence that is recited for a DsiRNA of the invention. In certain embodiments, the DsiRNA is more potent than any 21, 22 or 23mer siRNA that targets the same 21 nucleotide target sequence that is recited for a DsiRNA of the invention. As noted above, such potency assessments are most effectively performed upon dsRNAs that are suitably formulated (e.g., formulated with an appropriate transfection reagent) at a concentration of 1 nM or less. Optionally, an $IC_{50}$ assessment is performed to evaluate activity across a range of effective inhibitory concentrations, thereby allowing for robust comparison of the relative potencies of dsRNAs so assayed.

The dsRNA molecules of the invention are added directly, or can be complexed with lipids (e.g., cationic lipids), packaged within liposomes, or otherwise delivered to target cells or tissues. The nucleic acid or nucleic acid complexes can be locally administered to relevant tissues ex vivo, or in vivo through direct dermal application, transdermal application, or injection, with or without their incorporation in biopolymers. In particular embodiments, the nucleic acid molecules of the invention comprise sequences shown in FIG. 1, and the below exemplary structures. Examples of such nucleic acid molecules consist essentially of sequences defined in these figures and exemplary structures. Furthermore, where such agents are modified in accordance with the below description of modification patterning of DsiRNA agents, chemically modified forms of constructs described in FIG. 1, and the below exemplary structures can be used in all uses described for the DsiRNA agents of FIG. 1, and the below exemplary structures.

In another aspect, the invention provides mammalian cells containing one or more dsRNA molecules of this invention. The one or more dsRNA molecules can independently be targeted to the same or different sites.

Modified Structures of Anti-α-1 Antitrypsin DsiRNA Agents

In certain embodiments, the anti-α-1 antitrypsin DsiRNA agents of the invention can have the following structures:

In one such embodiment, the DsiRNA comprises:

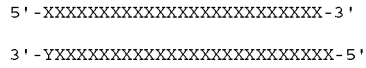

wherein "X"=RNA and "Y" is an overhang domain comprised of 1-4 RNA monomers that are optionally 2'-O-methyl RNA monomers. In a related embodiment, the DsiRNA comprises:

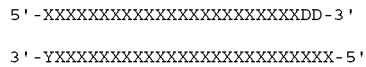

wherein "X"=RNA, "Y" is an overhang domain comprised of 1-4 RNA monomers that are optionally 2'-O-methyl RNA monomers, and "D"=DNA. In one embodiment, the top strand is the sense strand, and the bottom strand is the antisense strand. Alternatively, the bottom strand is the sense strand and the top strand is the antisense strand.

DsiRNAs of the invention can carry a broad range of modification patterns (e.g., 2'-O-methyl RNA patterns, e.g., within extended DsiRNA agents). Certain modification patterns of the second strand of DsiRNAs of the invention are presented below.

In one embodiment, the DsiRNA comprises:

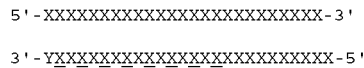

wherein "X"=RNA, "X̲"=2'-O-methyl RNA, "Y" is an overhang domain comprised of 1-4 RNA monomers that are optionally 2'-O-methyl RNA monomers and underlined residues are 2'-O-methyl RNA monomers. In a related embodiment, the DsiRNA comprises:

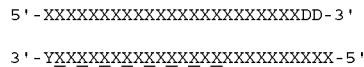

wherein "X"=RNA, "X̲"=2'-O-methyl RNA, "Y" is an overhang domain comprised of 1-4 RNA monomers that are optionally 2'-O-methyl RNA monomers and underlined residues are 2'-O-methyl RNA monomers, and "D"=DNA. The top strand is the sense strand, and the bottom strand is the antisense strand.

In another such embodiment, the DsiRNA comprises:

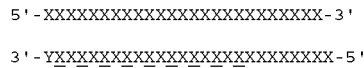

wherein "X"=RNA, "X̲"=2'-O-methyl RNA, "Y" is an overhang domain comprised of 1-4 RNA monomers that are optionally 2'-O-methyl RNA monomers and underlined residues are 2'-O-methyl RNA monomers. In a related embodiment, the DsiRNA comprises:

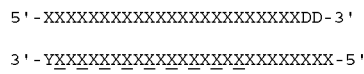

wherein "X"=RNA, "X̲"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand.

In another such embodiment, the DsiRNA comprises:

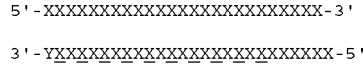

wherein "X"=RNA, "X̲"=2'-O-methyl RNA, "Y" is an overhang domain comprised of 1-4 RNA monomers that are optionally 2'-O-methyl RNA monomers and underlined residues are 2'-O-methyl RNA monomers. In a related embodiment, the DsiRNA comprises:

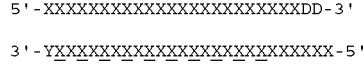

wherein "X"=RNA, "X̲"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand.

In further embodiments, the DsiRNA comprises:

wherein "X"=RNA, "X̲"=2'-O-methyl RNA, "Y" is an overhang domain comprised of 1-4 RNA monomers that are optionally 2'-O-methyl RNA monomers and underlined residues are 2'-O-methyl RNA monomers. In a related embodiment, the DsiRNA comprises:

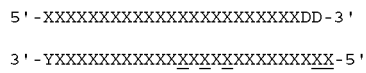

wherein "X"=RNA, "X̲"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In one related embodiment, the DsiRNA comprises:

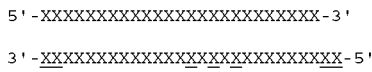

wherein "X"=RNA and "X̲"=2'-O-methyl RNA. In a further related embodiment, the DsiRNA comprises:

wherein "X"=RNA, "X̲"=2'-O-methyl RNA, and "D"=DNA. The top strand is the sense strand, and the bottom strand is the antisense strand. This modification pattern is also referred to herein as the "AS-M7" or "M7" modification pattern.

In additional embodiments, the DsiRNA comprises:

wherein "X"=RNA, "X̲"=2'-O-methyl RNA, "Y" is an overhang domain comprised of 1-4 RNA monomers that are optionally 2'-O-methyl RNA monomers and underlined residues are 2'-O-methyl RNA monomers. In a related embodiment, the DsiRNA comprises:

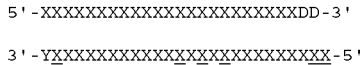

wherein "X"=RNA, "X̲"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. The top strand is the sense strand, and the bottom strand is the antisense strand. In another related embodiment, the DsiRNA comprises:

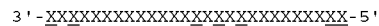

wherein "X"=RNA and "X̲"=2'-O-methyl RNA. The top strand is the sense strand, and the bottom strand is the antisense strand. In a further related embodiment, the DsiRNA comprises:

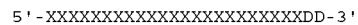

wherein "X"=RNA, "X̲"=2'-O-methyl RNA, and "D"=DNA. The top strand is the sense strand, and the bottom strand is the antisense strand. This modification pattern is also referred to herein as the "AS-M6" or "M6" modification pattern.

In other embodiments, the DsiRNA comprises:

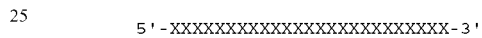
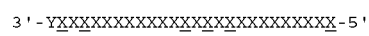

wherein "X"=RNA, "X̲"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In a related embodiment, the DsiRNA comprises:

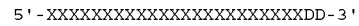
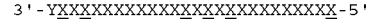

wherein "X"=RNA, "X̲"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In one related embodiment, the DsiRNA comprises:

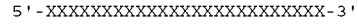

wherein "X"=RNA and "X̲"=2'-O-methyl RNA. The top strand is the sense strand, and the bottom strand is the antisense strand. In another related embodiment, the DsiRNA comprises:

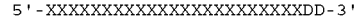
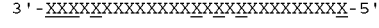

wherein "X"=RNA, "X̲"=2'-O-methyl RNA, and "D"=DNA. The top strand is the sense strand, and the bottom strand is the antisense strand. This modification pattern is also referred to herein as the "AS-M5" or "M5" modification pattern.

In further embodiments, the DsiRNA comprises:

```
5'-XXXXXXXXXXXXXXXXXXXXXXXXX-3'
3'-YXXXXXXXXXXXXXXXXXXXXXXXXXX-5'
``` wherein "X"=RNA, "X̱"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In a related embodiment, the DsiRNA comprises:

```
5'-XXXXXXXXXXXXXXXXXXXXXXXDD-3'
3'-YXXXXXXXXXXXXXXXXXXXXXXXXXX-5'
``` wherein "X"=RNA, "X̱"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In one related embodiment, the DsiRNA comprises:

```
5'-XXXXXXXXXXXXXXXXXXXXXXXXX-3'
3'-XXXXXXXXXXXXXXXXXXXXXXXXXX-5'
``` wherein "X"=RNA and "X̱"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXX-5'
``` wherein "X"=RNA, "X̱"=2'-O-methyl RNA, and "D"=DNA. The top strand is the sense strand, and the bottom strand is the antisense strand. This modification pattern is also referred to herein as the "AS-M4" or "M4" modification pattern.

In additional embodiments, the DsiRNA comprises:

```
5'-XXXXXXXXXXXXXXXXXXXXXXXXX-3'
3'-YXXXXXXXXXXXXXXXXXXXXXXXXXX-5'
``` wherein "X"=RNA, "X̱"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In a related embodiment, the DsiRNA comprises:

```
5'-XXXXXXXXXXXXXXXXXXXXXXXDD-3'
3'-YXXXXXXXXXXXXXXXXXXXXXXXXXX-5'
``` wherein "X"=RNA, "X̱"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXXX-5'
``` wherein "X"=RNA and "X̱"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXX-5'
``` wherein "X"=RNA, "X̱"=2'-O-methyl RNA, and "D"=DNA. The top strand is the sense strand, and the bottom strand is the antisense strand. This modification pattern is also referred to herein as the "AS-M8" or "M8" modification pattern.

In other embodiments, the DsiRNA comprises:

```
5'-XXXXXXXXXXXXXXXXXXXXXXXXX-3'
3'-YXXXXXXXXXXXXXXXXXXXXXXXXXX-5'
``` wherein "X"=RNA, "X̱"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXDD-3'
3'-YXXXXXXXXXXXXXXXXXXXXXXXXXX-5'
``` wherein "X"=RNA, "X̱"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXXX-5'
``` wherein "X"=RNA and "X̱"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXX-5'
``` wherein "X"=RNA, "X̱"=2'-O-methyl RNA, and "D"=DNA. The top strand is the sense strand, and the bottom strand is the antisense strand. This modification pattern is also referred to herein as the "AS-M3" or "M3" modification pattern.

In additional embodiments, the DsiRNA comprises:

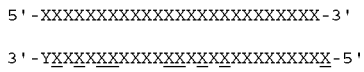

wherein "X"=RNA, "X̲"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In a related embodiment, the DsiRNA comprises:

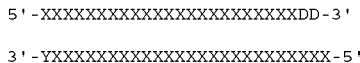

wherein "X"=RNA, "X̲"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

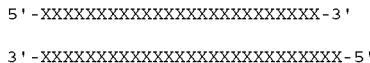

wherein "X"=RNA and "X̲"=2'-O-methyl RNA. The top strand is the sense strand, and the bottom strand is the antisense strand. In a further related embodiment, the DsiRNA comprises:

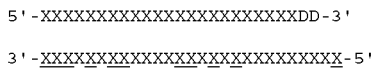

wherein "X"=RNA, "X̲"=2'-O-methyl RNA, and "D"=DNA. The top strand is the sense strand, and the bottom strand is the antisense strand. This modification pattern is also referred to herein as the "AS-M2" or "M2" modification pattern.

In further embodiments, the DsiRNA comprises:

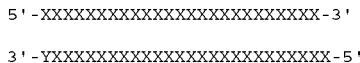

wherein "X"=RNA, "X̲"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In a related embodiment, the DsiRNA comprises:

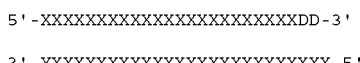

wherein "X"=RNA, "X̲"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

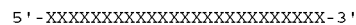

wherein "X"=RNA and "X̲"=2'-O-methyl RNA. The top strand is the sense strand, and the bottom strand is the antisense strand. In a further related embodiment, the DsiRNA comprises:

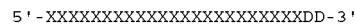
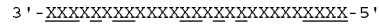

wherein "X"=RNA, "X̲"=2'-O-methyl RNA, and "D"=DNA. The top strand is the sense strand, and the bottom strand is the antisense strand. This modification pattern is also referred to herein as the "AS-M1" or "M1" modification pattern.

In additional embodiments, the DsiRNA comprises:

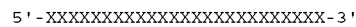
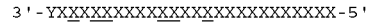

wherein "X"=RNA, "X̲"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

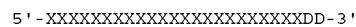
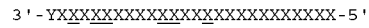

wherein "X"=RNA, "X̲"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

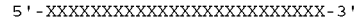

wherein "X"=RNA and "X̲"=2'-O-methyl RNA. The top strand is the sense strand, and the bottom strand is the antisense strand. In a further related embodiment, the DsiRNA comprises:

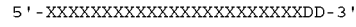
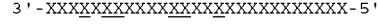

wherein "X"=RNA, "X̲"=2'-O-methyl RNA, and "D"=DNA. The top strand is the sense strand, and the bottom strand is the antisense strand. This modification pattern is also referred to herein as the "AS-M9" or "M9" modification pattern.

In other embodiments, the DsiRNA comprises:

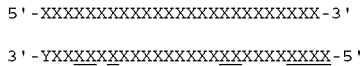

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In a related embodiment, the DsiRNA comprises:

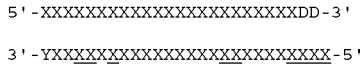

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

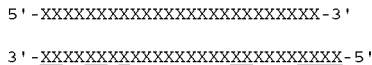

wherein "X"=RNA and "X"=2'-O-methyl RNA. The top strand is the sense strand, and the bottom strand is the antisense strand. In a further related embodiment, the DsiRNA comprises:

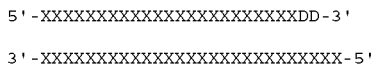

wherein "X"=RNA, "X"=2'-O-methyl RNA, and "D"=DNA. The top strand is the sense strand, and the bottom strand is the antisense strand. This modification pattern is also referred to herein as the "AS-M10" or "M10" modification pattern.

In further embodiments, the DsiRNA comprises:

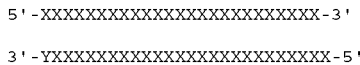

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

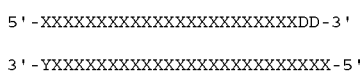

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

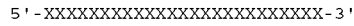
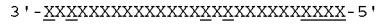

wherein "X"=RNA and "X"=2'-O-methyl RNA. The top strand is the sense strand, and the bottom strand is the antisense strand. In a further related embodiment, the DsiRNA comprises:

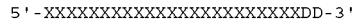
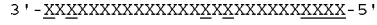

wherein "X"=RNA, "X"=2'-O-methyl RNA, and "D"=DNA. The top strand is the sense strand, and the bottom strand is the antisense strand. This modification pattern is also referred to herein as the "AS-M11" or "M11" modification pattern.

In additional embodiments, the DsiRNA comprises:

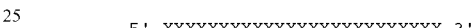
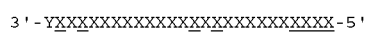

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

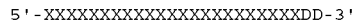
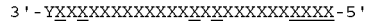

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

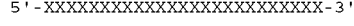
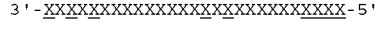

wherein "X"=RNA and "X"=2'-O-methyl RNA. The top strand is the sense strand, and the bottom strand is the antisense strand. In a further related embodiment, the DsiRNA comprises:

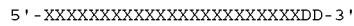
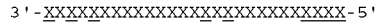

wherein "X"=RNA, "X"=2'-O-methyl RNA, and "D"=DNA. The top strand is the sense strand, and the bottom strand is the antisense strand. This modification pattern is also referred to herein as the "AS-M12" or "M12" modification pattern.

In further embodiments, the DsiRNA comprises:

```
5'-XXXXXXXXXXXXXXXXXXXXXXXXX-3'
3'-YXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXDD-3'
3'-YXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M13" or "M13" modification pattern.

In other embodiments, the DsiRNA comprises:

```
5'-XXXXXXXXXXXXXXXXXXXXXXXXX-3'
3'-YXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In another related embodiment, the DsiRNA comprises:

```
5'-XXXXXXXXXXXXXXXXXXXXXXXDD-3'
3'-YXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M21" or "M21" modification pattern.

In further embodiments, the DsiRNA comprises:

```
5'-XXXXXXXXXXXXXXXXXXXXXXXXX-3'
3'-YXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXDD-3'
3'-YXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M14" or "M14" modification pattern.

In additional embodiments, the DsiRNA comprises:

```
5'-XXXXXXXXXXXXXXXXXXXXXXXXX-3'
3'-YXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXDD-3'
3'-YXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M15" or "M15" modification pattern.

In further embodiments, the DsiRNA comprises:

```
5'-XXXXXXXXXXXXXXXXXXXXXXXXX-3'
3'-YXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In a related embodiment, the DsiRNA comprises:

```
5'-XXXXXXXXXXXXXXXXXXXXXXXDD-3'
3'-YXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M16" or "M16" modification pattern.

In additional embodiments, the DsiRNA comprises:

```
5'-XXXXXXXXXXXXXXXXXXXXXXXXX-3'
3'-YXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXDD-3'
3'-YXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M17" or "M17" modification pattern.

In further embodiments, the DsiRNA comprises:

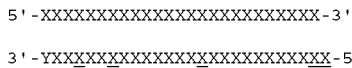

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

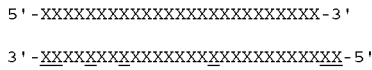

wherein "X"=RNA and "X"=2'-O-methyl RNA. The top strand is the sense strand, and the bottom strand is the antisense strand. In a further related embodiment, the DsiRNA comprises:

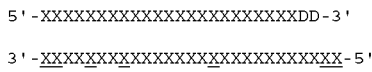

wherein "X"=RNA, "X"=2'-O-methyl RNA, and "D"=DNA. The top strand is the sense strand, and the bottom strand is the antisense strand. This modification pattern is also referred to herein as the "AS-M18" or "M18" modification pattern.

In additional embodiments, the DsiRNA comprises:

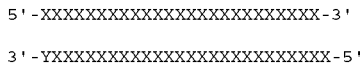

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

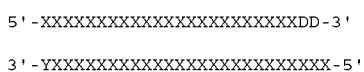

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

wherein "X"=RNA and "X"=2'-O-methyl RNA. The top strand is the sense strand, and the bottom strand is the antisense strand. In a further related embodiment, the DsiRNA comprises:

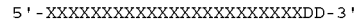

wherein "X"=RNA, "X"=2'-O-methyl RNA, and "D"=DNA. The top strand is the sense strand, and the bottom strand is the antisense strand. This modification pattern is also referred to herein as the "AS-M19" or "M19" modification pattern.

In further embodiments, the DsiRNA comprises:

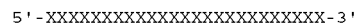
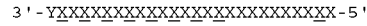

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

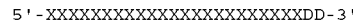
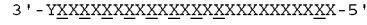

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

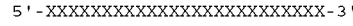

wherein "X"=RNA and "X"=2'-O-methyl RNA. The top strand is the sense strand, and the bottom strand is the antisense strand. In a further related embodiment, the DsiRNA comprises:

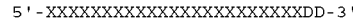
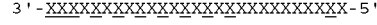

wherein "X"=RNA, "X"=2'-O-methyl RNA, and "D"=DNA. The top strand is the sense strand, and the bottom strand is the antisense strand. This modification pattern is also referred to herein as the "AS-M20" or "M20" modification pattern.

In additional embodiments, the DsiRNA comprises:

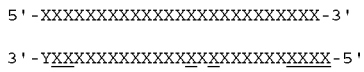

wherein "X"=RNA, "X̲"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

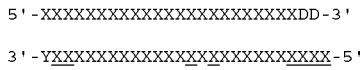

wherein "X"=RNA, "X̲"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

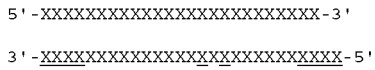

wherein "X"=RNA and "X̲"=2'-O-methyl RNA. The top strand is the sense strand, and the bottom strand is the antisense strand. In a further related embodiment, the DsiRNA comprises:

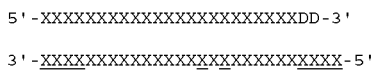

wherein "X"=RNA, "X̲"=2'-O-methyl RNA, and "D"=DNA. The top strand is the sense strand, and the bottom strand is the antisense strand. This modification pattern is also referred to herein as the "AS-M22" or "M22" modification pattern.

In further embodiments, the DsiRNA comprises:

wherein "X"=RNA, "X̲"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

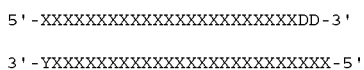

wherein "X"=RNA, "X̲"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

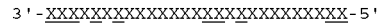

wherein "X"=RNA and "X̲"=2'-O-methyl RNA. The top strand is the sense strand, and the bottom strand is the antisense strand. In a further related embodiment, the DsiRNA comprises:

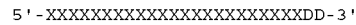
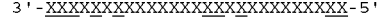

wherein "X"=RNA, "X̲"=2'-O-methyl RNA, and "D"=DNA. The top strand is the sense strand, and the bottom strand is the antisense strand. This modification pattern is also referred to herein as the "AS-M24" or "M24" modification pattern.

In additional embodiments, the DsiRNA comprises:

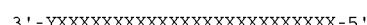

wherein "X"=RNA, "X̲"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

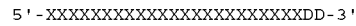
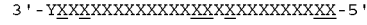

wherein "X"=RNA, "X̲"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

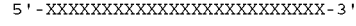

wherein "X"=RNA and "X̲"=2'-O-methyl RNA. The top strand is the sense strand, and the bottom strand is the antisense strand. In a further related embodiment, the DsiRNA comprises:

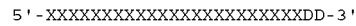
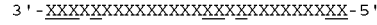

wherein "X"=RNA, "X̲"=2'-O-methyl RNA, and "D"=DNA. The top strand is the sense strand, and the bottom strand is the antisense strand. This modification pattern is also referred to herein as the "AS-M25" or "M25" modification pattern.

In further embodiments, the DsiRNA comprises:

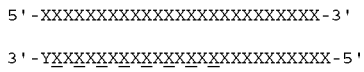

wherein "X"=RNA, "X̲"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

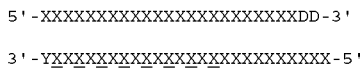

wherein "X"=RNA, "X̲"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

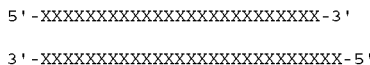

wherein "X"=RNA and "X̲"=2'-O-methyl RNA. The top strand is the sense strand, and the bottom strand is the antisense strand. In a further related embodiment, the DsiRNA comprises:

wherein "X"=RNA, "X̲"=2'-O-methyl RNA, and "D"=DNA. The top strand is the sense strand, and the bottom strand is the antisense strand. This modification pattern is also referred to herein as the "AS-M26" or "M26" modification pattern.

In additional embodiments, the DsiRNA comprises:

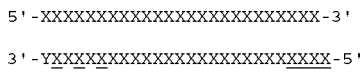

wherein "X"=RNA, "X̲"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

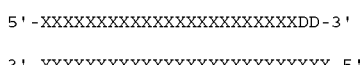

wherein "X"=RNA, "X̲"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

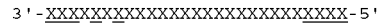

wherein "X"=RNA and "X̲"=2'-O-methyl RNA. The top strand is the sense strand, and the bottom strand is the antisense strand. In a further related embodiment, the DsiRNA comprises:

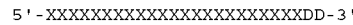
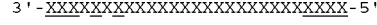

wherein "X"=RNA, "X̲"=2'-O-methyl RNA, and "D"=DNA. The top strand is the sense strand, and the bottom strand is the antisense strand. This modification pattern is also referred to herein as the "AS-M27" or "M27" modification pattern.

In further embodiments, the DsiRNA comprises:

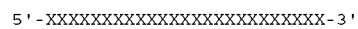
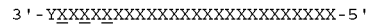

wherein "X"=RNA, "X̲"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

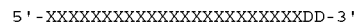
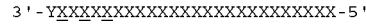

wherein "X"=RNA, "X̲"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

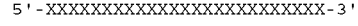

wherein "X"=RNA and "X̲"=2'-O-methyl RNA. The top strand is the sense strand, and the bottom strand is the antisense strand. In a further related embodiment, the DsiRNA comprises:

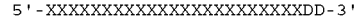

wherein "X"=RNA, "X̲"=2'-O-methyl RNA, and "D"=DNA. The top strand is the sense strand, and the bottom strand is the antisense strand. This modification pattern is also referred to herein as the "AS-M28" or "M28" modification pattern.

In further embodiments, the DsiRNA comprises:

```
5'-XXXXXXXXXXXXXXXXXXXXXXXXX-3'
3'-YXXXXXXXXXXXXXXXXXXXXXXXXX-5'
``` wherein "X"=RNA, "X̲"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXDD-3'
3'-YXXXXXXXXXXXXXXXXXXXXXXXXX-5'
``` wherein "X"=RNA, "X̲"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-X̲XXXXXXXXXXXXXXXXXXXXXXXXX-5'
``` wherein "X"=RNA and "X̲"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-X̲XXXXXXXXXXXXXXXXXXXXXXXXX-5'
``` wherein "X"=RNA, "X̲"=2'-O-methyl RNA, and "D"=DNA. The top strand is the sense strand, and the bottom strand is the antisense strand. This modification pattern is also referred to herein as the "AS-M29" or "M29" modification pattern.

In additional embodiments, the DsiRNA comprises:

```
5'-XXXXXXXXXXXXXXXXXXXXXXXXX-3'
3'-XXXXXXXXXXXXXXXXXXXXXXXXX-5'
``` wherein "X"=RNA and "X̲"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXX-5'
``` wherein "X"=RNA, "X̲"=2'-O-methyl RNA, and "D"=DNA. The top strand is the sense strand, and the bottom strand is the antisense strand. This modification pattern is also referred to herein as the "AS-M30" or "M30" modification pattern.

In further embodiments, the DsiRNA comprises:

```
5'-XXXXXXXXXXXXXXXXXXXXXXXXX-3'
3'-XXXXXXXXXXXXXXXXXXXXXXXXX-5'
``` wherein "X"=RNA and "X̲"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXX-5'
``` wherein "X"=RNA, "X̲"=2'-O-methyl RNA, and "D"=DNA. The top strand is the sense strand, and the bottom strand is the antisense strand. This modification pattern is also referred to herein as the "AS-M31" or "M31" modification pattern.

In additional embodiments, the DsiRNA comprises:

```
5'-XXXXXXXXXXXXXXXXXXXXXXXXX-3'
3'-XXXXXXXXXXXXXXXXXXXXXXXXX-5'
``` wherein "X"=RNA and "X̲"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXX-5'
``` wherein "X"=RNA, "X̲"=2'-O-methyl RNA, and "D"=DNA. The top strand is the sense strand, and the bottom strand is the antisense strand. This modification pattern is also referred to herein as the "AS-M32" or "M32" modification pattern.

In further embodiments, the DsiRNA comprises:

```
5'-XXXXXXXXXXXXXXXXXXXXXXXXX-3'
3'-YXXXXXXXXXXXXXXXXXXXXXXXXX-5'
``` wherein "X"=RNA, "X̲"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXDD-3'
3'-YXXXXXXXXXXXXXXXXXXXXXXXXX-5'
``` wherein "X"=RNA, "X̲"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

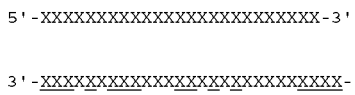

wherein "X"=RNA and "X"=2'-O-methyl RNA. The top strand is the sense strand, and the bottom strand is the antisense strand. In a further related embodiment, the DsiRNA comprises:

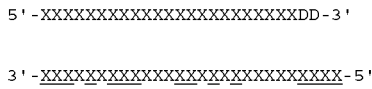

wherein "X"=RNA, "X"=2'-O-methyl RNA, and "D"=DNA. The top strand is the sense strand, and the bottom strand is the antisense strand. This modification pattern is also referred to herein as the "AS-M34" or "M34" modification pattern.

In additional embodiments, the DsiRNA comprises:

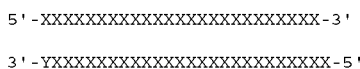

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

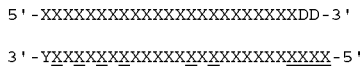

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

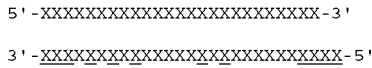

wherein "X"=RNA and "X"=2'-O-methyl RNA. The top strand is the sense strand, and the bottom strand is the antisense strand. In a further related embodiment, the DsiRNA comprises:

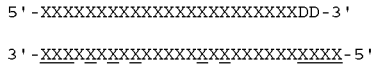

wherein "X"=RNA, "X"=2'-O-methyl RNA, and "D"=DNA. The top strand is the sense strand, and the bottom strand is the antisense strand. This modification pattern is also referred to herein as the "AS-M35" or "M35" modification pattern.

In further embodiments, the DsiRNA comprises:

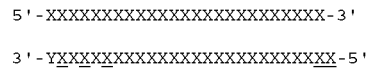

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

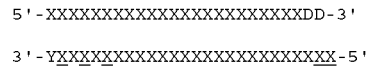

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

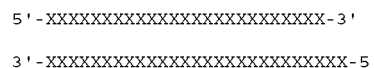

wherein "X"=RNA and "X"=2'-O-methyl RNA. The top strand is the sense strand, and the bottom strand is the antisense strand. In a further related embodiment, the DsiRNA comprises:

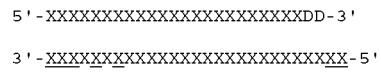

wherein "X"=RNA, "X"=2'-O-methyl RNA, and "D"=DNA. The top strand is the sense strand, and the bottom strand is the antisense strand. This modification pattern is also referred to herein as the "AS-M37" or "M37" modification pattern.

In additional embodiments, the DsiRNA comprises:

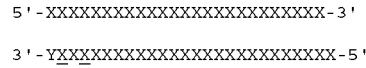

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

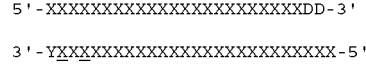

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

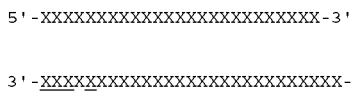

wherein "X"=RNA and "X"=2'-O-methyl RNA. The top strand is the sense strand, and the bottom strand is the antisense strand. In a further related embodiment, the DsiRNA comprises:

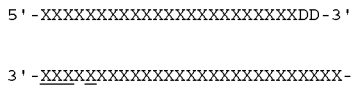

wherein "X"=RNA, "X"=2'-O-methyl RNA, and "D"=DNA. The top strand is the sense strand, and the bottom strand is the antisense strand. This modification pattern is also referred to herein as the "AS-M38" or "M38" modification pattern.

In further embodiments, the DsiRNA comprises:

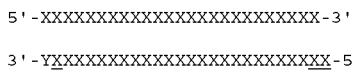

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

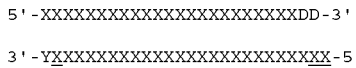

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

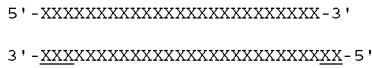

wherein "X"=RNA and "X"=2'-O-methyl RNA. The top strand is the sense strand, and the bottom strand is the antisense strand. In a further related embodiment, the DsiRNA comprises:

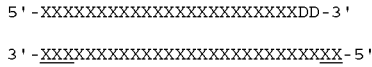

wherein "X"=RNA, "X"=2'-O-methyl RNA, and "D"=DNA. The top strand is the sense strand, and the bottom strand is the antisense strand. This modification pattern is also referred to herein as the "AS-M40" or "M40" modification pattern.

In additional embodiments, the DsiRNA comprises:

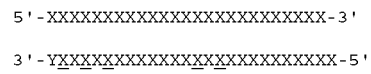

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

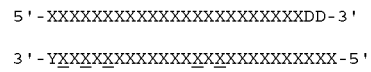

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

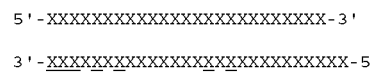

wherein "X"=RNA and "X"=2'-O-methyl RNA. The top strand is the sense strand, and the bottom strand is the antisense strand. In a further related embodiment, the DsiRNA comprises:

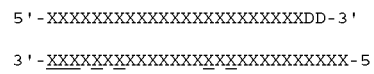

wherein "X"=RNA, "X"=2'-O-methyl RNA, and "D"=DNA. The top strand is the sense strand, and the bottom strand is the antisense strand. This modification pattern is also referred to herein as the "AS-M41" or "M41" modification pattern.

In further embodiments, the DsiRNA comprises:

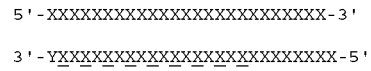

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'

3'-XXXXXXXXXXXXXXXXXXXXXXXXXXX-5'
``` wherein "X"=RNA and "X̲"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'

3'-XXXXXXXXXXXXXXXXXXXXXXXXXXX-5'
``` wherein "X"=RNA, "X̲"=2'-O-methyl RNA, and "D"=DNA. The top strand is the sense strand, and the bottom strand is the antisense strand. This modification pattern is also referred to herein as the "AS-M36" or "M36" modification pattern.

In additional embodiments, the DsiRNA comprises:

```
5'-XXXXXXXXXXXXXXXXXXXXXXXXX-3'

3'-YXXXXXXXXXXXXXXXXXXXXXXXXXXX-5'
``` wherein "X"=RNA, "X̲"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXDD-3'

3'-YXXXXXXXXXXXXXXXXXXXXXXXXXXX-5'
``` wherein "X"=RNA, "X̲"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'

3'-XXXXXXXXXXXXXXXXXXXXXXXXXXX-5'
``` wherein "X"=RNA and "X̲"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'

3'-XXXXXXXXXXXXXXXXXXXXXXXXXXX-5'
``` wherein "X"=RNA, "X̲"=2'-O-methyl RNA, and "D"=DNA. The top strand is the sense strand, and the bottom strand is the antisense strand. This modification pattern is also referred to herein as the "AS-M42" or "M42" modification pattern.

In further embodiments, the DsiRNA comprises:

```
5'-XXXXXXXXXXXXXXXXXXXXXXXXX-3'

3'-YXXXXXXXXXXXXXXXXXXXXXXXXXXX-5'
``` wherein "X"=RNA, "X̲"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXDD-3'

3'-YXXXXXXXXXXXXXXXXXXXXXXXXXXX-5'
``` wherein "X"=RNA, "X̲"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'

3'-XXXXXXXXXXXXXXXXXXXXXXXXXXX-5'
``` wherein "X"=RNA and "X̲"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'

3'-XXXXXXXXXXXXXXXXXXXXXXXXXXX-5'
``` wherein "X"=RNA, "X̲"=2'-O-methyl RNA, and "D"=DNA. The top strand is the sense strand, and the bottom strand is the antisense strand. This modification pattern is also referred to herein as the "AS-M43" or "M43" modification pattern.

In additional embodiments, the DsiRNA comprises:

```
5'-XXXXXXXXXXXXXXXXXXXXXXXXX-3'

3'-YXXXXXXXXXXXXXXXXXXXXXXXXXXX-5'
``` wherein "X"=RNA, "X̲"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXDD-3'

3'-YXXXXXXXXXXXXXXXXXXXXXXXXXXX-5'
``` wherein "X"=RNA, "X̲"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'

3'-XXXXXXXXXXXXXXXXXXXXXXXXXXX-5'
``` wherein "X"=RNA and "X̲"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'

3'-XXXXXXXXXXXXXXXXXXXXXXXXXXX-5'
``` wherein "X"=RNA, "X̲"=2'-O-methyl RNA, and "D"=DNA. The top strand is the sense strand, and the bottom strand is the antisense strand. This modification pattern is also referred to herein as the "AS-M44" or "M44" modification pattern.

In further embodiments, the DsiRNA comprises:

```
5'-XXXXXXXXXXXXXXXXXXXXXXXXX-3'

3'-YXXXXXXXXXXXXXXXXXXXXXXXXXX-5'
``` wherein "X"=RNA, "X̲"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXDD-3'

3'-YXXXXXXXXXXXXXXXXXXXXXXXXXX-5'
``` wherein "X"=RNA, "X̲"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'

3'-XXXXXXXXXXXXXXXXXXXXXXXXXXX-5'
``` wherein "X"=RNA and "X̲"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'

3'-XXXXXXXXXXXXXXXXXXXXXXXXXXX-5'
``` wherein "X"=RNA, "X̲"=2'-O-methyl RNA, and "D"=DNA. The top strand is the sense strand, and the bottom strand is the antisense strand. This modification pattern is also referred to herein as the "AS-M45" or "M45" modification pattern.

In additional embodiments, the DsiRNA comprises:

```
5'-XXXXXXXXXXXXXXXXXXXXXXXXX-3'

3'-YXXXXXXXXXXXXXXXXXXXXXXXXXX-5'
``` wherein "X"=RNA, "X̲"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXDD-3'

3'-YXXXXXXXXXXXXXXXXXXXXXXXXXX-5'
``` wherein "X"=RNA, "X̲"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'

3'-XXXXXXXXXXXXXXXXXXXXXXXXXXX-5'
``` wherein "X"=RNA and "X̲"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'

3'-XXXXXXXXXXXXXXXXXXXXXXXXXXX-5'
``` wherein "X"=RNA, "X̲"=2'-O-methyl RNA, and "D"=DNA. The top strand is the sense strand, and the bottom strand is the antisense strand. This modification pattern is also referred to herein as the "AS-M46" or "M46" modification pattern.

In further embodiments, the DsiRNA comprises:

```
5'-XXXXXXXXXXXXXXXXXXXXXXXXX-3'

3'-YXXXXXXXXXXXXXXXXXXXXXXXXXX-5'
``` wherein "X"=RNA, "X̲"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXDD-3'

3'-YXXXXXXXXXXXXXXXXXXXXXXXXXX-5'
``` wherein "X"=RNA, "X̲"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

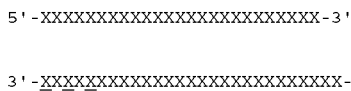

wherein "X"=RNA and "X"=2'-O-methyl RNA. The top strand is the sense strand, and the bottom strand is the antisense strand. In a further related embodiment, the DsiRNA comprises:

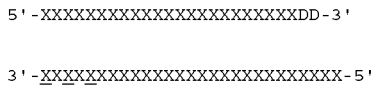

wherein "X"=RNA, "X"=2'-O-methyl RNA, and "D"=DNA. The top strand is the sense strand, and the bottom strand is the antisense strand. This modification pattern is also referred to herein as the "AS-M47" or "M47" modification pattern.

In additional embodiments, the DsiRNA comprises:

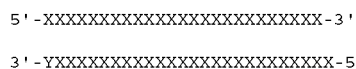

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

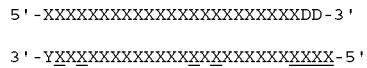

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

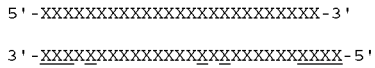

wherein "X"=RNA and "X"=2'-O-methyl RNA. The top strand is the sense strand, and the bottom strand is the antisense strand. In a further related embodiment, the DsiRNA comprises:

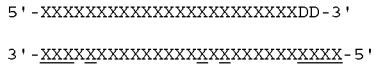

wherein "X"=RNA, "X"=2'-O-methyl RNA, and "D"=DNA. The top strand is the sense strand, and the bottom strand is the antisense strand. This modification pattern is also referred to herein as the "AS-M48" or "M48" modification pattern.

In further embodiments, the DsiRNA comprises:

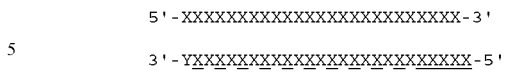

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

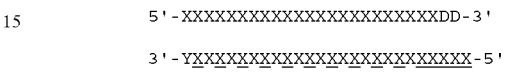

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

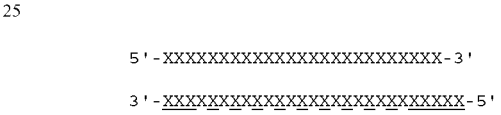

wherein "X"=RNA and "X"=2'-O-methyl RNA. The top strand is the sense strand, and the bottom strand is the antisense strand. In a further related embodiment, the DsiRNA comprises:

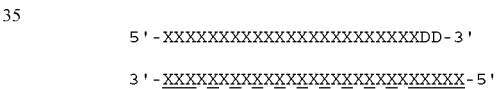

wherein "X"=RNA, "X"=2'-O-methyl RNA, and "D"=DNA. The top strand is the sense strand, and the bottom strand is the antisense strand. This modification pattern is also referred to herein as the "AS-M52" or "M52" modification pattern.

In further embodiments, the DsiRNA comprises:

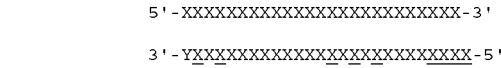

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

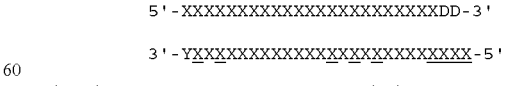

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'

3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'

3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M54" or "M54" modification pattern.

In additional embodiments, the DsiRNA comprises:

```
5'-XXXXXXXXXXXXXXXXXXXXXXXXX-3'

3'-YXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXDD-3'

3'-YXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'

3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'

3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M55" or "M55" modification pattern.

In further embodiments, the DsiRNA comprises:

```
5'-XXXXXXXXXXXXXXXXXXXXXXXXX-3'

3'-YXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXDD-3'

3'-YXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'

3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'

3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M56" or "M56" modification pattern.

In additional embodiments, the DsiRNA comprises:

```
5'-XXXXXXXXXXXXXXXXXXXXXXXXX-3'

3'-YXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXDD-3'

3'-YXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'

3'-XXXXXXXXXXXXXXXXXXXXXXXXXXX-5'
``` wherein "X"=RNA and "X̲"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXDD-3'

3'-XXXXXXXXXXXXXXXXXXXXXXXXXXX-5'
``` wherein "X"=RNA, "X̲"=2'-O-methyl RNA, and "D"=DNA. The top strand is the sense strand, and the bottom strand is the antisense strand. This modification pattern is also referred to herein as the "AS-M57" or "M57" modification pattern.

In further embodiments, the DsiRNA comprises:

```
5'-XXXXXXXXXXXXXXXXXXXXXXXXX-3'

3'-YXXXXXXXXXXXXXXXXXXXXXXXXXXX-5'
``` wherein "X"=RNA, "X̲"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXXDD-3'

3'-YXXXXXXXXXXXXXXXXXXXXXXXXXXX-5'
``` wherein "X"=RNA, "X̲"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'

3'-XXXXXXXXXXXXXXXXXXXXXXXXXXX-5'
``` wherein "X"=RNA and "X̲"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXDD-3'

3'-XXXXXXXXXXXXXXXXXXXXXXXXXXX-5'
``` wherein "X"=RNA, "X̲"=2'-O-methyl RNA, and "D"=DNA. The top strand is the sense strand, and the bottom strand is the antisense strand. This modification pattern is also referred to herein as the "AS-M58" or "M58" modification pattern.

In additional embodiments, the DsiRNA comprises:

```
5'-XXXXXXXXXXXXXXXXXXXXXXXXX-3'

3'-YXXXXXXXXXXXXXXXXXXXXXXXXXXX-5'
``` wherein "X"=RNA, "X̲"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXXDD-3'

3'-YXXXXXXXXXXXXXXXXXXXXXXXXXXX-5'
``` wherein "X"=RNA, "X̲"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'

3'-XXXXXXXXXXXXXXXXXXXXXXXXXXX-5'
``` wherein "X"=RNA and "X̲"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXDD-3'

3'-XXXXXXXXXXXXXXXXXXXXXXXXXXX-5'
``` wherein "X"=RNA, "X̲"=2'-O-methyl RNA, and "D"=DNA. The top strand is the sense strand, and the bottom strand is the antisense strand. This modification pattern is also referred to herein as the "AS-M59" or "M59" modification pattern.

In further embodiments, the DsiRNA comprises:

```
5'-XXXXXXXXXXXXXXXXXXXXXXXXX-3'

3'-YXXXXXXXXXXXXXXXXXXXXXXXXXXX-5'
``` wherein "X"=RNA, "X̲"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXXDD-3'

3'-YXXXXXXXXXXXXXXXXXXXXXXXXXXX-5'
``` wherein "X"=RNA, "X̲"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

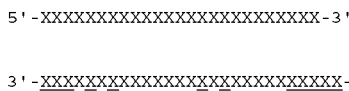

wherein "X"=RNA and "X"=2'-O-methyl RNA. The top strand is the sense strand, and the bottom strand is the antisense strand. In a further related embodiment, the DsiRNA comprises:

wherein "X"=RNA, "X"=2'-O-methyl RNA, and "D"=DNA. The top strand is the sense strand, and the bottom strand is the antisense strand. This modification pattern is also referred to herein as the "AS-M60" or "M60" modification pattern.

In additional embodiments, the DsiRNA comprises:

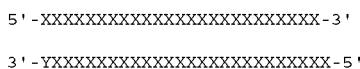

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

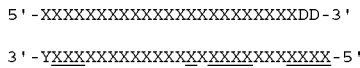

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

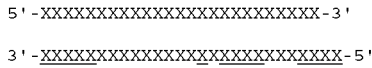

wherein "X"=RNA and "X"=2'-O-methyl RNA. The top strand is the sense strand, and the bottom strand is the antisense strand. In a further related embodiment, the DsiRNA comprises:

wherein "X"=RNA, "X"=2'-O-methyl RNA, and "D"=DNA. The top strand is the sense strand, and the bottom strand is the antisense strand. This modification pattern is also referred to herein as the "AS-M61" or "M61" modification pattern.

In further embodiments, the DsiRNA comprises:

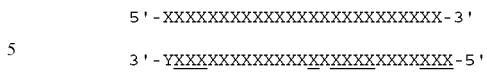

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

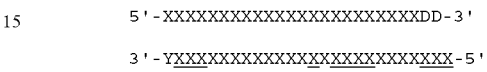

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

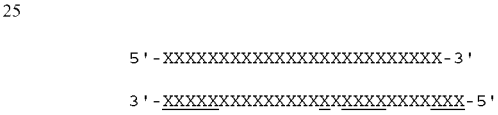

wherein "X"=RNA and "X"=2'-O-methyl RNA. The top strand is the sense strand, and the bottom strand is the antisense strand. In a further related embodiment, the DsiRNA comprises:

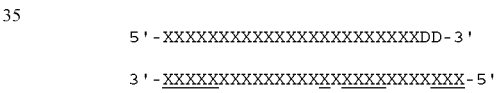

wherein "X"=RNA, "X"=2'-O-methyl RNA, and "D"=DNA. The top strand is the sense strand, and the bottom strand is the antisense strand. This modification pattern is also referred to herein as the "AS-M62" or "M62" modification pattern.

In additional embodiments, the DsiRNA comprises:

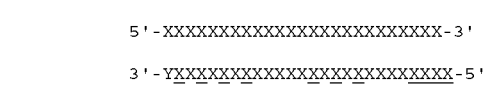

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

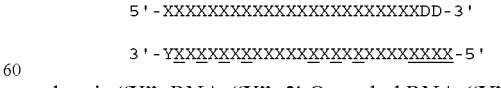

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

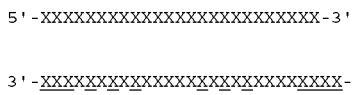

wherein "X"=RNA and "X"=2'-O-methyl RNA. The top strand is the sense strand, and the bottom strand is the antisense strand. In a further related embodiment, the DsiRNA comprises:

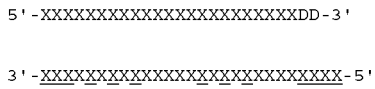

wherein "X"=RNA, "X"=2'-O-methyl RNA, and "D"=DNA. The top strand is the sense strand, and the bottom strand is the antisense strand. This modification pattern is also referred to herein as the "AS-M63" or "M63" modification pattern.

In further embodiments, the DsiRNA comprises:

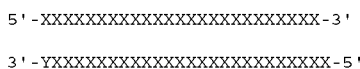

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

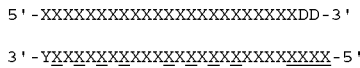

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

wherein "X"=RNA and "X"=2'-O-methyl RNA. The top strand is the sense strand, and the bottom strand is the antisense strand. In a further related embodiment, the DsiRNA comprises:

wherein "X"=RNA, "X"=2'-O-methyl RNA, and "D"=DNA. The top strand is the sense strand, and the bottom strand is the antisense strand. This modification pattern is also referred to herein as the "AS-M64" or "M64" modification pattern.

In additional embodiments, the DsiRNA comprises:

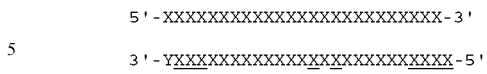

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

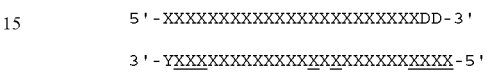

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

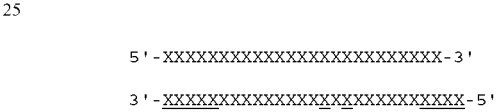

wherein "X"=RNA and "X"=2'-O-methyl RNA. The top strand is the sense strand, and the bottom strand is the antisense strand. In a further related embodiment, the DsiRNA comprises:

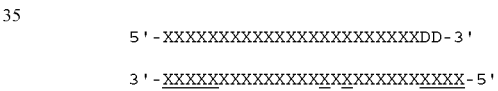

wherein "X"=RNA, "X"=2'-O-methyl RNA, and "D"=DNA. The top strand is the sense strand, and the bottom strand is the antisense strand. This modification pattern is also referred to herein as the "AS-M65" or "M65" modification pattern.

In further embodiments, the DsiRNA comprises:

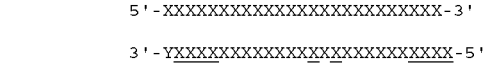

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

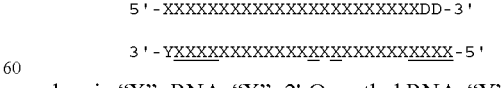

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

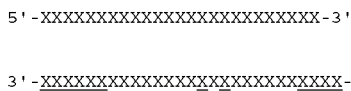

wherein "X"=RNA and "X"=2'-O-methyl RNA. The top strand is the sense strand, and the bottom strand is the antisense strand. In a further related embodiment, the DsiRNA comprises:

wherein "X"=RNA, "X"=2'-O-methyl RNA, and "D"=DNA. The top strand is the sense strand, and the bottom strand is the antisense strand. This modification pattern is also referred to herein as the "AS-M66" or "M66" modification pattern.

In additional embodiments, the DsiRNA comprises:

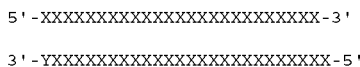

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

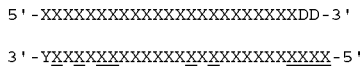

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

wherein "X"=RNA and "X"=2'-O-methyl RNA. The top strand is the sense strand, and the bottom strand is the antisense strand. In a further related embodiment, the DsiRNA comprises:

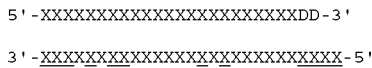

wherein "X"=RNA, "X"=2'-O-methyl RNA, and "D"=DNA. The top strand is the sense strand, and the bottom strand is the antisense strand. This modification pattern is also referred to herein as the "AS-M67" or "M67" modification pattern.

In further embodiments, the DsiRNA comprises:

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

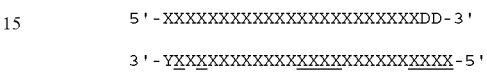

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

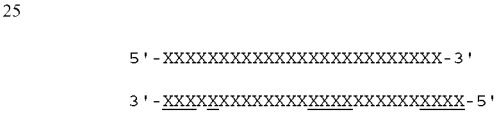

wherein "X"=RNA and "X"=2'-O-methyl RNA. The top strand is the sense strand, and the bottom strand is the antisense strand. In a further related embodiment, the DsiRNA comprises:

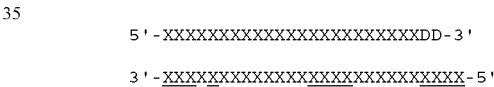

wherein "X"=RNA, "X"=2'-O-methyl RNA, and "D"=DNA. The top strand is the sense strand, and the bottom strand is the antisense strand. This modification pattern is also referred to herein as the "AS-M68" or "M68" modification pattern.

In additional embodiments, the DsiRNA comprises:

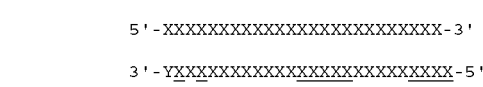

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

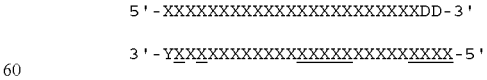

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

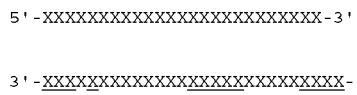

wherein "X"=RNA and "X"=2'-O-methyl RNA. The top strand is the sense strand, and the bottom strand is the antisense strand. In a further related embodiment, the DsiRNA comprises:

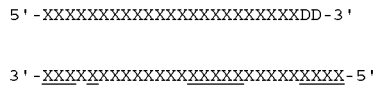

wherein "X"=RNA, "X"=2'-O-methyl RNA, and "D"=DNA. The top strand is the sense strand, and the bottom strand is the antisense strand. This modification pattern is also referred to herein as the "AS-M69" or "M69" modification pattern.

In further embodiments, the DsiRNA comprises:

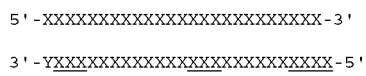

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

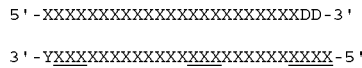

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

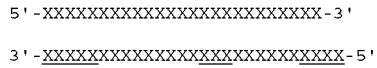

wherein "X"=RNA and "X"=2'-O-methyl RNA. The top strand is the sense strand, and the bottom strand is the antisense strand. In a further related embodiment, the DsiRNA comprises:

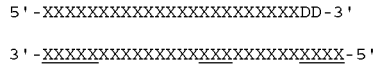

wherein "X"=RNA, "X"=2'-O-methyl RNA, and "D"=DNA. The top strand is the sense strand, and the bottom strand is the antisense strand. This modification pattern is also referred to herein as the "AS-M70" or "M70" modification pattern.

In additional embodiments, the DsiRNA comprises:

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

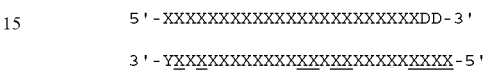

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

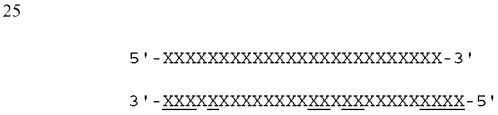

wherein "X"=RNA and "X"=2'-O-methyl RNA. The top strand is the sense strand, and the bottom strand is the antisense strand. In a further related embodiment, the DsiRNA comprises:

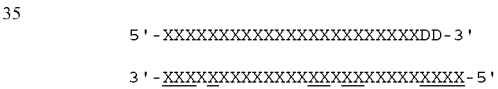

wherein "X"=RNA, "X"=2'-O-methyl RNA, and "D"=DNA. The top strand is the sense strand, and the bottom strand is the antisense strand. This modification pattern is also referred to herein as the "AS-M71" or "M71" modification pattern.

In further embodiments, the DsiRNA comprises:

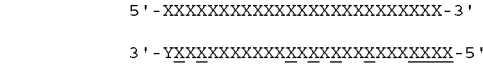

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

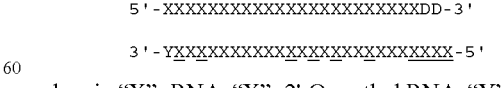

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

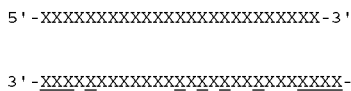

wherein "X"=RNA and "X"=2'-O-methyl RNA. The top strand is the sense strand, and the bottom strand is the antisense strand. In a further related embodiment, the DsiRNA comprises:

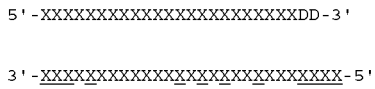

wherein "X"=RNA, "X"=2'-O-methyl RNA, and "D"=DNA. The top strand is the sense strand, and the bottom strand is the antisense strand. This modification pattern is also referred to herein as the "AS-M72" or "M72" modification pattern.

In additional embodiments, the DsiRNA comprises:

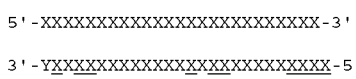

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

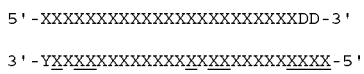

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

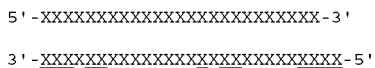

wherein "X"=RNA and "X"=2'-O-methyl RNA. The top strand is the sense strand, and the bottom strand is the antisense strand. In a further related embodiment, the DsiRNA comprises:

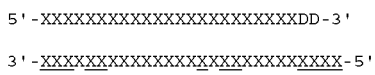

wherein "X"=RNA, "X"=2'-O-methyl RNA, and "D"=DNA. The top strand is the sense strand, and the bottom strand is the antisense strand. This modification pattern is also referred to herein as the "AS-M73" or "M73" modification pattern.

In additional embodiments, the DsiRNA comprises:

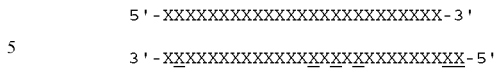

wherein "X"=RNA and "X"=2'-O-methyl RNA. In a further related embodiment, the DsiRNA comprises:

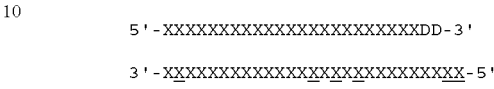

wherein "X"=RNA, "X"=2'-O-methyl RNA, and "D"=DNA. The top strand is the sense strand, and the bottom strand is the antisense strand. This modification pattern is also referred to herein as the "AS-M7*" or "M7*" modification pattern.

In further embodiments, the DsiRNA comprises:

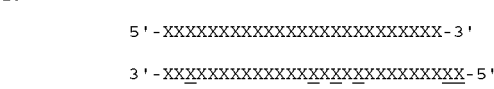

wherein "X"=RNA and "X"=2'-O-methyl RNA. The top strand is the sense strand, and the bottom strand is the antisense strand. In a further related embodiment, the DsiRNA comprises:

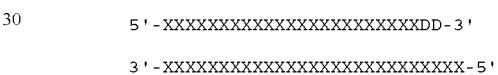

wherein "X"=RNA, "X"=2'-O-methyl RNA, and "D"=DNA. The top strand is the sense strand, and the bottom strand is the antisense strand. This modification pattern is also referred to herein as the "AS-M6*" or "M6*" modification pattern.

In other embodiments, the DsiRNA comprises:

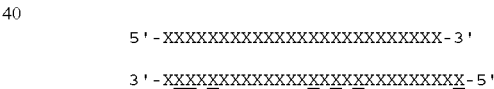

wherein "X"=RNA and "X"=2'-O-methyl RNA. The top strand is the sense strand, and the bottom strand is the antisense strand. In another related embodiment, the DsiRNA comprises:

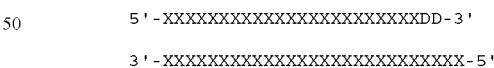

wherein "X"=RNA, "X"=2'-O-methyl RNA, and "D"=DNA. The top strand is the sense strand, and the bottom strand is the antisense strand. This modification pattern is also referred to herein as the "AS-M5*" or "M5*" modification pattern.

In further embodiments, the DsiRNA comprises:

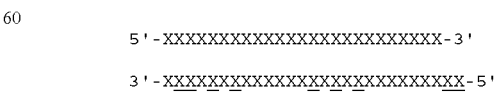

wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M4*" or "M4*" modification pattern.

In additional embodiments, the DsiRNA comprises:

```
5'-XXXXXXXXXXXXXXXXXXXXXXXXX-3'
3'-XXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M8*" or "M8*" modification pattern.

In additional embodiments, the DsiRNA comprises:

```
5'-XXXXXXXXXXXXXXXXXXXXXXXXX-3'
3'-XXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M2*" or "M2*" modification pattern.

In other embodiments, the DsiRNA comprises:

```
5'-XXXXXXXXXXXXXXXXXXXXXXXXX-3'
3'-XXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M10*" or "M10*" modification pattern.

In further embodiments, the DsiRNA comprises:

```
5'-XXXXXXXXXXXXXXXXXXXXXXXXX-3'
3'-XXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M11*" or "M11*" modification pattern.

In further embodiments, the DsiRNA comprises:

```
5'-XXXXXXXXXXXXXXXXXXXXXXXXX-3'
3'-XXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M13*" or "M13*" modification pattern.

In further embodiments, the DsiRNA comprises:

```
5'-XXXXXXXXXXXXXXXXXXXXXXXXX-3'
3'-XXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M14*" or "M14*" modification pattern.

In additional embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M15*" or "M15*" modification pattern.

In further embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M16*" or "M16*" modification pattern.

In additional embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M17*" or "M17*" modification pattern.

In further embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M18*" or "M18*" modification pattern.

In additional embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M19*" or "M19*" modification pattern.

In further embodiments, the DsiRNA comprises:

```
5'-XXXXXXXXXXXXXXXXXXXXXXXDD-3'
3'-YXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M20*" or "M20*" modification pattern.

In additional embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M22*" or "M22*" modification pattern.

In further embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M24*" or "M24*" modification pattern.

In additional embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M25*" or "M25*" modification pattern.

In further embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M26*" or "M26*" modification pattern.

In additional embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M27*" or "M27*" modification pattern.

In additional embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M28*" or "M28*" modification pattern.

In further embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXX-5'
``` wherein "X"=RNA, "X̲"=2'-O-methyl RNA, and "D"=DNA. The top strand is the sense strand, and the bottom strand is the antisense strand. This modification pattern is also referred to herein as the "AS-M29*" or "M29*" modification pattern.

In additional embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X̲"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXX-5'
``` wherein "X"=RNA, "X̲"=2'-O-methyl RNA, and "D"=DNA. The top strand is the sense strand, and the bottom strand is the antisense strand. This modification pattern is also referred to herein as the "AS-M34*" or "M34*" modification pattern.

In further embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X̲"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXX-5'
``` wherein "X"=RNA, "X̲"=2'-O-methyl RNA, and "D"=DNA. The top strand is the sense strand, and the bottom strand is the antisense strand. This modification pattern is also referred to herein as the "AS-M35*" or "M35*" modification pattern.

In additional embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X̲"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXX-5'
``` wherein "X"=RNA, "X̲"=2'-O-methyl RNA, and "D"=DNA. The top strand is the sense strand, and the bottom strand is the antisense strand. This modification pattern is also referred to herein as the "AS-M37*" or "M37*" modification pattern.

In further embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X̲"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXX-5'
``` wherein "X"=RNA, "X̲"=2'-O-methyl RNA, and "D"=DNA. The top strand is the sense strand, and the bottom strand is the antisense strand. This modification pattern is also referred to herein as the "AS-M38*" or "M38*" modification pattern.

In further embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X̲"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXX-5'
``` wherein "X"=RNA, "X̲"=2'-O-methyl RNA, and "D"=DNA. The top strand is the sense strand, and the bottom strand is the antisense strand. This modification pattern is also referred to herein as the "AS-M40*" or "M40*" modification pattern.

In additional embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X̲"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXX-5'
``` wherein "X"=RNA, "X̲"=2'-O-methyl RNA, and "D"=DNA. The top strand is the sense strand, and the bottom strand is the antisense strand. This modification pattern is also referred to herein as the "AS-M41*" or "M41*" modification pattern.

In further embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M36*" or "M36*" modification pattern.

In additional embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M42*" or "M42*" modification pattern.

In further embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M43*" or "M43*" modification pattern.

In additional embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M44*" or "M44*" modification pattern.

In further embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M46*" or "M46*" modification pattern.

In additional embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M47*" or "M47*" modification pattern.

In further embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M48*" or "M48*" modification pattern.

In additional embodiments, the DsiRNA comprises:

```
5'-XXXXXXXXXXXXXXXXXXXXXXXXX-3'
3'-XXXXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M52*" or "M52*" modification pattern.

In further embodiments, the DsiRNA comprises:

```
5'-XXXXXXXXXXXXXXXXXXXXXXXXX-3'
3'-XXXXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M54*" or "M54*" modification pattern.

In additional embodiments, the DsiRNA comprises:

```
5'-XXXXXXXXXXXXXXXXXXXXXXXXX-3'
3'-XXXXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M55*" or "M55*" modification pattern.

In further embodiments, the DsiRNA comprises:

```
5'-XXXXXXXXXXXXXXXXXXXXXXXXX-3'
3'-XXXXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M56*" or "M56*" modification pattern.

In additional embodiments, the DsiRNA comprises:

```
5'-XXXXXXXXXXXXXXXXXXXXXXXXX-3'
3'-XXXXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M57*" or "M57*" modification pattern.

In further embodiments, the DsiRNA comprises:

```
5'-XXXXXXXXXXXXXXXXXXXXXXXXX-3'
3'-XXXXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M58*" or "M58*" modification pattern.

In additional embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M59*" or "M59*" modification pattern.

In further embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M60*" or "M60*" modification pattern.

In additional embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M61*" or "M61*" modification pattern.

In further embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M62*" or "M62*" modification pattern.

In additional embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M63*" or "M63*" modification pattern.

In further embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M64*" or "M64*" modification pattern.

In additional embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M65*" or "M65*" modification pattern.

In further embodiments, the DsiRNA comprises:

```
5'-XXXXXXXXXXXXXXXXXXXXXXXXX-3'
3'-XXXXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M66*" or "M66*" modification pattern.

In additional embodiments, the DsiRNA comprises:

```
5'-XXXXXXXXXXXXXXXXXXXXXXXXX-3'
3'-XXXXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M67*" or "M67*" modification pattern.

In further embodiments, the DsiRNA comprises:

```
5'-XXXXXXXXXXXXXXXXXXXXXXXXX-3'
3'-XXXXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M68*" or "M68*" modification pattern.

In additional embodiments, the DsiRNA comprises:

```
5'-XXXXXXXXXXXXXXXXXXXXXXXXX-3'
3'-XXXXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M69*" or "M69*" modification pattern.

In further embodiments, the DsiRNA comprises:

```
5'-XXXXXXXXXXXXXXXXXXXXXXXXX-3'
3'-XXXXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M70*" or "M70*" modification pattern.

In additional embodiments, the DsiRNA comprises:

```
5'-XXXXXXXXXXXXXXXXXXXXXXXXX-3'
3'-XXXXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M71*" or "M71*" modification pattern.

In further embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M72*" or "M72*" modification pattern.

In additional embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M73*" or "M73*" modification pattern.

Additional exemplary antisense strand modifications include the following:

```
3'-XXXXXXXXXXXXXXXXXXXXXXXXXXX-5'  "AS-M74"
3'-XXXXXXXXXXXXXXXXXXXXXXXXXXX-5'  "AS-M75"
3'-XXXXXXXXXXXXXXXXXXXXXXXXXXX-5'  "AS-M76"
3'-XXXXXXXXXXXXXXXXXXXXXXXXXXX-5'  "AS-M77"
3'-XXXXXXXXXXXXXXXXXXXXXXXXXXX-5'  "AS-M78"
3'-XXXXXXXXXXXXXXXXXXXXXXXXXXX-5'  "AS-M79"
3'-XXXXXXXXXXXXXXXXXXXXXXXXXXX-5'  "AS-M80"
3'-XXXXXXXXXXXXXXXXXXXXXXXXXXX-5'  "AS-M81"
3'-XpXXXXXXXXXXXXXXXXXXXXXXXXXX-5'  "AS-M82"
3'-XpXXXXXXXXXXXXXXXXXXXXXXXXXX-5'  "AS-M83"
3'-XXXXXXXXXXXXXXXXXXXXXXXXXXX-5'  "AS-M84"
3'-XXXXXXXXXXXXXXXXXXXXXXXXXXX-5'  "AS-M85"
3'-FFFXXXXXXXXXXXXXXXXXXXXFFFF-5'  "AS-M88"
3'-XXXXFXXXFXFXXXXXXXXXXXXXXX-5'  "AS-M89"
3'-FFFXFXFXFXFXFXFXXXXXXXFFFF-5'  "AS-M90"
3'-FFFXXXXXXXXXXXXXXXXXXXXXXFF-5'  "AS-M91"
3'-XXXXXXFXXXXXFXFXXXXXXXXXXX-5'  "AS-M92"
3'-FFFXFXXXXXXXXXXXFXXXXXXXXX-5'  "AS-M93"
3'-FFFXFXFXXXXXFXFXFXXXXXFFFF-5'  "AS-M94"
3'-FFFXFXFXFXFXFXFXXXXXXXFFFF-5'  "AS-M95"
3'-FFFXFXFXFXFXFXFXXXXXXXFFFpF-5'  "AS-M96"
3'-XXXXXXXXXXXXXXXXXXXXXXXXXXX-5'  "AS-M210"
3'-XXXXXXXXXXXXXXXXXXXXXXXXXXX-5'  "AS-M74*"
3'-XXXXXXXXXXXXXXXXXXXXXXXXXXX-5'  "AS-M75*"
3'-XXXXXXXXXXXXXXXXXXXXXXXXXXX-5'  "AS-M76*"
3'-XXXXXXXXXXXXXXXXXXXXXXXXXXX-5'  "AS-M77*"
3'-XXXXXXXXXXXXXXXXXXXXXXXXXXX-5'  "AS-M78*"
3'-XXXXXXXXXXXXXXXXXXXXXXXXXXX-5'  "AS-M79*"
3'-XXXXXXXXXXXXXXXXXXXXXXXXXXX-5'  "AS-M80*"
3'-XpXXXXXXXXXXXXXXXXXXXXXXXXXX-5'  "AS-M82*"
3'-XpXXXXXXXXXXXXXXXXXXXXXXXXXX-5'  "AS-M83*"
3'-XXXXXXXXXXXXXXXXXXXXXXXXXXX-5'  "AS-M84*"
3'-XFFXXXXXXXXXXXXXXXXXXXXFFFF-5'  "AS-M88*"
3'-XXXXFXXXFXFXXXXXXXXXXXXXXX-5'  "AS-M89*"
3'-XFFXFXFXFXFXFXFXXXXXXXFFFF-5'  "AS-M90*"
3'-XFFXXXXXXXXXXXXXXXXXXXXXXFF-5'  "AS-M91*"
3'-XXXXXXFXXXXXFXFXXXXXXXXXXX-5'  "AS-M92*"
3'-XFFXFXXXXXXXXXXXFXXXXXXXXX-5'  "AS-M93*"
3'-XFFXFXFXXXXXFXFXFXXXXXFFFF-5'  "AS-M94*"
3'-XFFXFXFXFXFXFXFXXXXXXXFFFF-5'  "AS-M95*"
3'-XFFXFXFXFXFXFXFXXXXXXXFFFpF-5'  "AS-M96*"
3'-XXXXXXXXXXXXXXXXXXXXXXXXXXX-5'  "AS-M210*"
``` where "X"=RNA, "X"=2'-O-methyl RNA, "D"=DNA, "F"=2'-Fluoro NA and "p"=Phosphorothioate linkage.

In certain additional embodiments, the antisense strand of selected dsRNAs of the invention are extended, optionally at the 5' end, with an exemplary 5' extension of base "AS-M8", "AS-M17" and "AS-M48" modification patterns respectively represented as follows:

(SEQ ID NO: 3493)
```
3'-XXXXXXXXXXXXXXXXXXXXXXXXXXXUAGCUAUCGT-5'
```
"AS-M8, extended"

(SEQ ID NO: 3493)
```
3'-XXXXXXXXXXXXXXXXXXXXXXXXXXXUAGCUAUCGT-5'
```
"AS-M17, extended"

(SEQ ID NO: 3493)
```
3'-XXXXXXXXXXXXXXXXXXXXXXXXXXXUAGCUAUCGT-5'
```
"AS-M48, extended"

where "X"=RNA; "X̲"=2'-O-methyl RNA; "F"=2'-Fluoro NA and "A" in bold, italics indicates a 2'-Fluoro-adenine residue.

In certain embodiments, the sense strand of a DsiRNA of the invention is modified—specific exemplary forms of sense strand modifications are shown below, and it is contemplated that such modified sense strands can be substituted for the sense strand of any of the DsiRNAs shown above to generate a DsiRNA comprising a below-depicted sense strand that anneals with an above-depicted antisense strand. Exemplary sense strand modification patterns include:

5'-XX̲X̲X̲XXXXXXXXXXX̲X̲X̲X̲X̲XXXXX̲DD-3' "SM1"
5'-X̲X̲X̲X̲X̲XXXXXXXXXXXXXXXXXXXDD-3' "SM2"
5'-XXX̲X̲X̲X̲X̲XXXXXXXXXXXXXXXXDD-3' "SM3"
5'-XXXXXX̲X̲X̲X̲X̲XXXXXXXXXXXXXDD-3' "SM4"
5'-XXXXXXXXXX̲X̲X̲X̲X̲XXXXXXXXXDD-3' "SM5"
5'-XXXXXXXXXXXXX̲X̲X̲X̲X̲XXXXXXDD-3' "SM6"
5'-XXXXXXXXXXXXXXXX̲X̲X̲X̲X̲XXXDD-3' "SM7"
5'-XXXXXXXXXXXXXXXXXXXX̲X̲X̲X̲X̲DD-3' "SM8"
5'-XXXXXXXXXXXXXXXXXXXXXXX̲X̲X̲DD-3' "SM9"
5'-XXXXXXXXXXXXXXXXX̲X̲X̲X̲X̲X̲XXDD-3' "SM10"
5'-X̲X̲X̲X̲X̲X̲X̲X̲XXXXXXXXXXX̲X̲XXXXDD-3' "SM11"
5'-X̲X̲X̲X̲X̲X̲XXXXX̲X̲X̲X̲XXXXXXXXXDD-3' "SM12"
5'-XXX̲X̲X̲X̲X̲X̲X̲XXXXXXXXX̲X̲X̲X̲XXDD-3' "SM13"
5'-X̲X̲X̲X̲X̲X̲XXXXXXXXXXXXXX̲X̲X̲X̲X̲DD-3' "SM14"
5'-X̲X̲X̲X̲XXXXXXXXXXXXXXXXXXXXDD-3' "SM15"
5'-X̲X̲X̲X̲X̲X̲XXXXXXXXXXXXXX̲X̲X̲DD-3' "SM16"
5'-X̲X̲X̲X̲X̲X̲X̲X̲X̲X̲XXXXXXXX̲X̲X̲X̲XDD-3' "SM17"
5'-X̲X̲X̲X̲XXX̲X̲X̲XXXXX̲X̲X̲XXXXXXDD-3' "SM18"
5'-X̲X̲X̲X̲X̲X̲XXXXXXX̲X̲X̲X̲XXXXXXDD-3' "SM19"
5'-X̲X̲X̲X̲X̲X̲XXXXXXXXXXX̲X̲X̲X̲X̲XDD-3' "SM20"
5'-X̲X̲X̲X̲X̲X̲X̲XXXXXXXXXX̲X̲X̲X̲X̲XDD-3' "SM21"
5'-X̲X̲X̲X̲X̲X̲X̲X̲XXXXXXXX̲X̲X̲X̲XXXDD-3' "SM23"
5'-X̲X̲X̲X̲X̲X̲X̲X̲X̲XXXXXXX̲X̲X̲X̲X̲X̲XDD-3' "SM24"
5'-X̲X̲X̲X̲X̲X̲X̲X̲X̲X̲XXXXXX̲X̲X̲X̲X̲X̲XDD-3' "SM25"
5'-X̲X̲X̲X̲X̲X̲X̲X̲X̲X̲X̲XXXXX̲X̲X̲X̲X̲X̲XDD-3' "SM30"
5'-X̲X̲X̲X̲X̲X̲X̲X̲X̲X̲X̲X̲XXXX̲X̲X̲X̲X̲X̲XDD-3' "SM31"
5'-X̲X̲X̲X̲X̲X̲X̲X̲X̲X̲X̲X̲X̲XXXX̲X̲X̲X̲X̲XDD-3' "SM32"
5'-X̲X̲X̲X̲X̲X̲X̲X̲X̲X̲X̲X̲X̲X̲XXX̲X̲X̲X̲X̲XDD-3' "SM33"
5'-X̲X̲X̲X̲X̲X̲X̲X̲X̲X̲X̲X̲X̲X̲X̲XX̲X̲X̲X̲X̲XDD-3' "SM34"
5'-X̲X̲X̲X̲X̲X̲X̲X̲X̲X̲X̲X̲X̲X̲X̲X̲X̲X̲X̲X̲X̲XDD-3' "SM35"
5'-X̲X̲X̲X̲X̲X̲X̲X̲X̲X̲X̲X̲X̲X̲X̲X̲X̲X̲X̲X̲XXDD-3' "SM36"
5'-X̲X̲X̲X̲X̲X̲X̲X̲X̲X̲X̲X̲X̲X̲X̲X̲X̲X̲X̲XXXDD-3' "SM37"
5'-X̲X̲X̲X̲X̲X̲X̲X̲X̲X̲X̲X̲X̲X̲X̲X̲X̲X̲XXXXDD-3' "SM38"

5'-XX̲X̲X̲X̲X̲X̲X̲X̲X̲X̲X̲X̲X̲X̲X̲X̲X̲XXXDD-3' "SM39"
5'-XX̲X̲X̲X̲X̲X̲X̲X̲X̲X̲X̲X̲X̲X̲X̲X̲X̲X̲X̲XDD-3' "SM40"
5'-XX̲X̲X̲X̲X̲X̲X̲X̲X̲X̲X̲X̲X̲X̲X̲X̲X̲X̲X̲X̲DD-3' "SM41"
5'-XX̲X̲X̲X̲X̲X̲X̲X̲X̲X̲X̲X̲X̲X̲X̲X̲X̲X̲X̲X̲DD-3' "SM42"
5'-XX̲X̲X̲X̲X̲X̲X̲X̲X̲X̲X̲X̲X̲X̲X̲X̲X̲X̲X̲X̲DD-3' "SM43"
5'-XX̲X̲X̲X̲X̲X̲X̲X̲X̲X̲X̲X̲X̲X̲X̲X̲X̲X̲X̲X̲DD-3' "SM44"
5'-XX̲X̲X̲X̲X̲X̲X̲X̲X̲X̲X̲X̲X̲X̲X̲X̲X̲X̲X̲X̲DD-3' "SM45", "SM47"
5'-XX̲X̲X̲X̲X̲X̲X̲X̲X̲X̲X̲X̲X̲X̲X̲X̲X̲X̲X̲X̲DD-3' "SM46"
5'-XX̲X̲X̲X̲X̲X̲X̲X̲X̲X̲X̲X̲X̲X̲X̲X̲X̲X̲X̲X̲DD-3' "SM48"
5'-XX̲X̲X̲X̲X̲X̲X̲X̲X̲X̲X̲X̲X̲X̲X̲X̲X̲X̲X̲X̲DD-3' "SM49"
5'-XX̲X̲X̲X̲X̲X̲X̲X̲X̲X̲X̲X̲X̲X̲X̲X̲X̲X̲X̲X̲DD-3' "SM50"
5'-XX̲X̲X̲X̲X̲X̲X̲X̲X̲X̲X̲X̲X̲X̲X̲X̲X̲X̲X̲X̲DD-3' "SM51"
5'-XX̲X̲X̲X̲X̲X̲X̲X̲X̲X̲X̲X̲X̲X̲X̲X̲X̲X̲X̲X̲DD-3' "SM52"
5'-XX̲X̲X̲X̲X̲X̲X̲X̲X̲X̲X̲X̲X̲X̲X̲X̲X̲X̲X̲X̲DD-3' "SM53"
5'-X̲X̲X̲X̲X̲X̲X̲X̲X̲X̲X̲X̲X̲X̲X̲X̲X̲X̲X̲X̲X̲XDD-3' "SM54"
5'-XX̲X̲X̲X̲X̲X̲X̲X̲X̲X̲X̲X̲X̲X̲X̲X̲X̲X̲X̲X̲DD-3' "SM55"
5'-XX̲X̲X̲X̲X̲X̲X̲X̲X̲X̲X̲X̲X̲X̲X̲X̲X̲X̲X̲X̲DD-3' "SM56"
5'-XX̲X̲X̲X̲X̲X̲X̲X̲X̲X̲X̲X̲X̲X̲X̲X̲X̲X̲X̲X̲DD-3' "SM57"
5'-XX̲X̲X̲X̲X̲X̲X̲X̲X̲X̲X̲X̲X̲X̲X̲X̲X̲X̲X̲X̲DD-3' "SM58"
5'-XX̲X̲X̲X̲X̲X̲X̲X̲X̲X̲X̲X̲X̲X̲X̲X̲X̲X̲X̲X̲DD-3' "SM59"
5'-XX̲X̲X̲X̲X̲X̲X̲X̲X̲X̲X̲X̲X̲X̲X̲X̲X̲X̲X̲X̲DD-3' "SM60"
5'-XXXXXXXXXXXXXXXXXXXXXXDD-3' "SM61"
5'-XXXXXXXXXXXXXXXXXXXXXXDD-3' "SM62"
5'-XXXXXXXXXXXXXXXXXXXXXXDD-3' "SM63"
5'-XXXXXXXXXXXXXXXXXXXXXXDD-3' "SM64"
5'-XXXXXXXXXXXXXXXXXXXXXXDD-3' "SM65"
5'-XXXXXXXXXXXXXXXXXXXXXXpDpD-3' "SM66"
5'-XpXXXXXXXXXXXXXXXXXXXXXXDD-3' "SM67"
5'-XpXXXXXXXXXXXXXXXXXXXXXXpDpD-3' "SM68"
5'-DXXXXXXXXXXXXXXXXXXXXXXDD-3' "SM69"
5'-DpXXXXXXXXXXXXXXXXXXXXXXpDpD-3' "SM70"
5'-DX̲DXXXXXXXXXXXXXXXXXXXXDD-3' "SM71"
5'-DpX̲DXXXXXXXXXXXXXXXXXXXXDD-3' "SM72"
5'-XX̲DXXXXXXXXXDXXXXXXXXXXDD-3' "SM73"
5'-XpX̲DXXXXXXXXXDXXXXXXXXXXDD-3' "SM74"
5'-DX̲DXXXXXXXXXDXXXXXDXXXXXDD-3' "SM75"
5'-DpX̲DXXXXXXXXXDXXXXXDXXXXXDD-3' "SM76"
5'-XpX̲pXXXXXXXXXXXXXXXXXXXXXDD-3' "SM77"
5'-XpX̲pXXXXXXXXXXXXXXXXXXXXXpDpD-3' "SM78"
5'-DpX̲pDXXXXXXXXXXXXXXXXXXXXDD-3' "SM79"

5'-XpXpDXXXXXXXXXDXXXXXXXXXXDD-3' "SM80"

5'-DXDXXXDXXXXXDXXXXXXXXXXDD-3' "SM81"

5'-DpXDXXXDXXXXXDXXXXDXXXXpDpD-3' "SM82"

5' C3 spacer-XXXXXXXXXXXXXXXXXXXXXXXXDD-3' "SM83"

5' C3 spacer-XXDXXXXXXXXXDXXXXXXXXXXDD-3' "SM84"

5' C3 spacer-XXXXXXXXXXXXXXXXXXXXXXXXpDpD-3' "SM85"

5'-XXXXXXXXXXXXXXXXXXXXXXXXpDpD-3' "SM86"

5'-XpXXXXXXXXXXXXXXXXXXXXXDD-3' "SM87"

5'-XpXXXXXXXXXXXXXXXXXXXXXpDpD-3' "SM88"

5'-DXXXXXXXXXXXXXXXXXXXXXXDD-3' "SM89"

5'-DpXXXXXXXXXXXXXXXXXXXXXXpDpD-3' "SM90"

5'-DXDXXXXXXXXXXXXXXXXXXXXDD-3' "SM91"

5'-DpXDXXXXXXXXXXXXXXXXXXXXDD-3' "SM92"

5'-XXDXXXXXXXXXXDXXXXXXXXXXDD-3' "SM93"

5'-XpXDXXXXXXXXXXDXXXXXXXXXXDD-3' "SM94"

5'-DXDXXXXXXXXXXDXXXXXDXXXXDD-3' "SM95"

5'-DpXDXXXXXXXXXXDXXXXXDXXXXDD-3' "SM96"

5'-XpXpXXXXXXXXXXXXXXXXXXXXDD-3' "SM97"

5'-XpXpXXXXXXXXXXXXXXXXXXXXXpDpD-3' "SM98"

5'-DpXpDXXXXXXXXXXXXXXXXXXXXDD-3' "SM99"

5'-XpXpDXXXXXXXXXDXXXXXXXXXXDD-3' "SM100"

5'-DXDXXXXXXXXXDXDXXXDDXXDDD-3' "SM101"

5'-DpXDXXXDXXXXXDXXXXXDXXXXpDpD-3' "SM102"

5' C3 spacer-XXXXXXXXXXXXXXXXXXXXXXXXDD-3' "SM103"

5' C3 spacer-XXDXXXXXXXXXDXXXXXXXXXXDD-3' "SM104"

5' C3 spacer-XXXXXXXXXXXXXXXXXXXXXXXXpDpD-3' "SM105"

5'-XXXXXXXXXXXXXXXXXXXXXXXXDD-3' "SM106"

5'-XXXXXXXXXXXXXXXXXXXXXXXXDD-3' "SM107"

5'-XXXXXXXXXXXXXXXXXXXXXXXXDD-3' "SM108"

5'-XFXXXXXXXXXXXXXXFXXXXXDD-3' "SM110"

5'-XXXFXFXXXXXXFXXXXXXXXXXDD-3' "SM111"

5'-XFXFXFXFXXXFXFXFXXXXXDD-3' "SM112"

5'-XpFXFXFXFXXXXFXFXFXXXXXpDpD-3' "SM113"

5'-XFXXXXXXXXXXXXXXXXXXXXDD-3' "SM114"

5'-XXXXFFXFXXXXFXFXXXXXXXDD-3' "SM115"

5'-XFXFXXXXXXXXXXXFXXXXXDD-3' "SM116"

5'-XFXFFFXFXXXXFXFXFFFXXXXXDD-3' "SM117"

5'-XFXFXFXFXXXXFXFXFXXXXXDD-3' "SM118"

5'-XpFXFXFXFXXXXFXFXFXXXXXpDpD-3' "SM119"

5'-XXXXXXXXXXXXXXXXXXXXXXXXDD-3' "SM250"

5'-XXXXXXXXXXXXXXXXXXXXXXXXDD-3' "SM251"

5'-XXXXXXXXXXXXXXXXXXXXXXXXDD-3' "SM252"

5'-XXXXXXXXXXXXXXXXXXXXXXXXX-3'

5'-XXXXXXXXXXXXXXXXXXXXXXXXX-3'

5'-XXXXXXXXXXXXXXXXXXXXXXXXX-3'

5'-XXXXXXXXXXXXXXXXXXXXXXXXX-3'

5'-XXXXXXXXXXXXXXXXXXXXXXXXX-3'

5'-XXXXXXXXXXXXXXXXXXXXXXXXX-3'

5'-XXXXXXXXXXXXXXXXXXXXXXXXX-3'

5'-XXXXXXXXXXXXXXXXXXXXXXXXX-3'

5'-XXXXXXXXXXXXXXXXXXXXXXXXX-3'

5'-XXXXXXXXXXXXXXXXXXXXXXXXX-3'

5'-XXXXXXXXXXXXXXXXXXXXXXXXX-3'

5'-XXXXXXXXXXXXXXXXXXXXXXXXX-3'

5'-XXXXXXXXXXXXXXXXXXXXXXXXX-3'

5'-XXXXXXXXXXXXXXXXXXXXXXXXX-3'

5'-XXXXXXXXXXXXXXXXXXXXXXXXX-3'

5'-XXXXXXXXXXXXXXXXXXXXXXXXX-3'

5'-XXXXXXXXXXXXXXXXXXXXXXXXX-3'

5'-XXXXXXXXXXXXXXXXXXXXXXXXX-3'

5'-XXXXXXXXXXXXXXXXXXXXXXXXX-3'

5'-XXXXXXXXXXXXXXXXXXXXXXXXX-3'

5'-XXXXXXXXXXXXXXXXXXXXXXXXX-3'

5'-XXXXXXXXXXXXXXXXXXXXXXXXX-3'

5'-XXXXXXXXXXXXXXXXXXXXXXXXX-3'

5'-XXXXXXXXXXXXXXXXXXXXXXXXX-3'

5'-XXXXXXXXXXXXXXXXXXXXXXXXX-3'

5'-XXXXXXXXXXXXXXXXXXXXXXXXX-3'

5'-XXXXXXXXXXXXXXXXXXXXXXXXX-3'

5'-XXXXXXXXXXXXXXXXXXXXXXXXX-3'

5'-XXXXXXXXXXXXXXXXXXXXXXXXX-3'

5'-XXXXXXXXXXXXXXXXXXXXXXXXX-3'

5'-XXXXXXXXXXXXXXXXXXXXXXXXX-3'

5'-XXXXXXXXXXXXXXXXXXXXXXXXX-3'

5'-XXXXXXXXXXXXXXXXXXXXXXXXX-3'

5'-XXXXXXXXXXXXXXXXXXXXXXXXX-3'

5'-XXXXXXXXXXXXXXXXXXXXXXXXX-3'

5'-XXXXXXXXXXXXXXXXXXXXXXXXX-3'

5'-XXXXXXXXXXXXXXXXXXXXXXXXX-3'

5'-XXXXXXXXXXXXXXXXXXXXXXXXX-3'

5'-XXXXXXXXXXXXXXXXXXXXXXXXX-3'

5'-XXXXXXXXXXXXXXXXXXXXXXXXX-3'

```
5'-XXXXXXXXXXXXXXXXXXXXXXXXXXX-3'

5'-XXXXXXXXXXXXXXXXXXXXXXXXXXX-3'

5'-XXXXXXXXXXXXXXXXXXXXXXXXXXX-3'

5'-XXXXXXXXXXXXXXXXXXXXXXXXXXX-3'

5'-XXXXXXXXXXXXXXXXXXXXXXXXXXX-3'

5'-XXXXXXXXXXXXXXXXXXXXXXXXXXX-3'

5'-XXXXXXXXXXXXXXXXXXXXXXXXXXX-3'

5'-XXXXXXXXXXXXXXXXXXXXXXXXXXXXX-3' "SM22"

5'-XXXXXXXXXXXXXXXXXXXXXXXXXXX-3

5'-XXXXXXXXXXXXXXXXXXXXXXXXXXX-3'

5'-XXXXXXXXXXXXXXXXXXXXXXXXXXX-3'
``` where "X"=RNA, "X"=2'-O-methyl RNA, "D"=DNA, "F"=2'-Fluoro NA and "p"=Phosphorothioate linkage.

The above modification patterns can also be incorporated into, e.g., the extended DsiRNA structures and mismatch and/or frayed DsiRNA structures described below.

In another embodiment, the DsiRNA comprises strands having equal lengths possessing 1-3 mismatched residues that serve to orient Dicer cleavage (specifically, one or more of positions 1, 2 or 3 on the first strand of the DsiRNA, when numbering from the 3'-terminal residue, are mismatched with corresponding residues of the 5'-terminal region on the second strand when first and second strands are annealed to one another). An exemplary 27mer DsiRNA agent with two terminal mismatched residues is shown:

```
5'-XXXXXXXXXXXXXXXXXXXXXXXXXXX$_M$M-3'
3'-XXXXXXXXXXXXXXXXXXXXXXXXXXX$_M$M-5'
``` wherein "X"=RNA, "M"=Nucleic acid residues (RNA, DNA or non-natural or modified nucleic acids) that do not base pair (hydrogen bond) with corresponding "M" residues of otherwise complementary strand when strands are annealed. Any of the residues of such agents can optionally be 2'-O-methyl RNA monomers—alternating positioning of 2'-O-methyl RNA monomers that commences from the 3'-terminal residue of the bottom (second) strand, as shown for above asymmetric agents, can also be used in the above "blunt/fray" DsiRNA agent. In one embodiment, the top strand is the sense strand, and the bottom strand is the antisense strand. Alternatively, the bottom strand is the sense strand and the top strand is the antisense strand.

In certain additional embodiments, the present invention provides compositions for RNA interference (RNAi) that possess one or more base paired deoxyribonucleotides within a region of a double stranded ribonucleic acid (dsRNA) that is positioned 3' of a projected sense strand Dicer cleavage site and correspondingly 5' of a projected antisense strand Dicer cleavage site. The compositions of the invention comprise a dsRNA which is a precursor molecule, i.e., the dsRNA of the present invention is processed in vivo to produce an active small interfering nucleic acid (siRNA). The dsRNA is processed by Dicer to an active siRNA which is incorporated into RISC.

In certain embodiments, the DsiRNA agents of the invention can have the following exemplary structures (noting that any of the following exemplary structures can be combined, e.g., with the bottom strand modification patterns of the above-described structures—in one specific example, the bottom strand modification pattern shown in any of the above structures is applied to the 27 most 3' residues of the bottom strand of any of the following structures; in another specific example, the bottom strand modification pattern shown in any of the above structures upon the 23 most 3' residues of the bottom strand is applied to the 23 most 3' residues of the bottom strand of any of the following structures):

In one such embodiment, the DsiRNA comprises the following (an exemplary "right-extended", "DNA extended" DsiRNA):

```
5'-XXXXXXXXXXXXXXXXXXXXXXXXX$_{N*}$D$_N$DD-3'
3'-YXXXXXXXXXXXXXXXXXXXXXXXXX$_{N*}$D$_N$XX-5'
``` wherein "X"=RNA, "Y" is an optional overhang domain comprised of 0-10 RNA monomers that are optionally 2'-O-methyl RNA monomers—in certain embodiments, "Y" is an overhang domain comprised of 1-4 RNA monomers that are optionally 2'-O-methyl RNA monomers, "D"=DNA, and "N"=1 to 50 or more, but is optionally 1-8 or 1-10. "N*"=0 to 15 or more, but is optionally 0, 1, 2, 3, 4, 5 or 6. In one embodiment, the top strand is the sense strand, and the bottom strand is the antisense strand. Alternatively, the bottom strand is the sense strand and the top strand is the antisense strand.

In a related embodiment, the DsiRNA comprises:

```
5'-XXXXXXXXXXXXXXXXXXXXXXXXX$_{N*}$D$_N$DD-3'
3'-YXXXXXXXXXXXXXXXXXXXXXXXXX$_{N*}$D$_N$DD-5'
``` wherein "X"=RNA, "Y" is an optional overhang domain comprised of 0-10 RNA monomers that are optionally 2'-O-methyl RNA monomers—in certain embodiments, "Y" is an overhang domain comprised of 1-4 RNA monomers that are optionally 2'-O-methyl RNA monomers, "D"=DNA, and "N"=1 to 50 or more, but is optionally 1-8 or 1-10. "N*"=0 to 15 or more, but is optionally 0, 1, 2, 3, 4, 5 or 6. In one embodiment, the top strand is the sense strand, and the bottom strand is the antisense strand. Alternatively, the bottom strand is the sense strand and the top strand is the antisense strand.

In an additional embodiment, the DsiRNA comprises:

```
5'-XXXXXXXXXXXXXXXXXXXXXXXXX$_{N*}$D$_N$DD-3'
3'-YXXXXXXXXXXXXXXXXXXXXXXXXX$_{N*}$D$_N$ZZ-5'
``` wherein "X"=RNA, "X"=2'-O-methyl RNA, "Y" is an optional overhang domain comprised of 0-10 RNA monomers that are optionally 2'-O-methyl RNA monomers—in certain embodiments, "Y" is an overhang domain comprised of 1-4 RNA monomers that are optionally 2'-O-methyl RNA monomers, "D"=DNA, "Z"=DNA or RNA, and "N"=1 to 50 or more, but is optionally 1-8 or 1-10. "N*"=0 to 15 or more, but is optionally 0, 1, 2, 3, 4, 5 or 6. In one embodiment, the top strand is the sense strand, and the bottom strand is the antisense strand. Alternatively, the bottom strand is the sense strand and the top strand is the antisense strand, with 2'-O-methyl RNA monomers located at alternating residues along the top strand, rather than the bottom strand presently depicted in the above schematic.

In another such embodiment, the DsiRNA comprises:

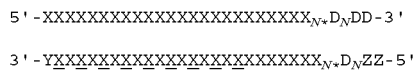

wherein "X"=RNA, "X"=2'-O-methyl RNA, "Y" is an optional overhang domain comprised of 0-10 RNA monomers that are optionally 2'-O-methyl RNA monomers—in certain embodiments, "Y" is an overhang domain comprised of 1-4 RNA monomers that are optionally 2'-O-methyl RNA monomers, "D"=DNA, "Z"=DNA or RNA, and "N"=1 to 50 or more, but is optionally 1-8 or 1-10. "N*"=0 to 15 or more, but is optionally 0, 1, 2, 3, 4, 5 or 6. In one embodiment, the top strand is the sense strand, and the bottom strand is the antisense strand. Alternatively, the bottom strand is the sense strand and the top strand is the antisense strand, with 2'-O-methyl RNA monomers located at alternating residues along the top strand, rather than the bottom strand presently depicted in the above schematic.

In another such embodiment, the DsiRNA comprises:

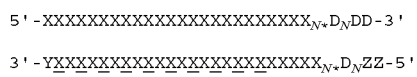

wherein "X"=RNA, "X"=2'-O-methyl RNA, "Y" is an optional overhang domain comprised of 0-10 RNA monomers that are optionally 2'-O-methyl RNA monomers—in certain embodiments, "Y" is an overhang domain comprised of 1-4 RNA monomers that are optionally 2'-O-methyl RNA monomers, "D"=DNA, "Z"=DNA or RNA, and "N"=1 to 50 or more, but is optionally 1-8 or 1-10. "N*"=0 to 15 or more, but is optionally 0, 1, 2, 3, 4, 5 or 6. In one embodiment, the top strand is the sense strand, and the bottom strand is the antisense strand. Alternatively, the bottom strand is the sense strand and the top strand is the antisense strand, with 2'-O-methyl RNA monomers located at alternating residues along the top strand, rather than the bottom strand presently depicted in the above schematic.

In another embodiment, the DsiRNA comprises:

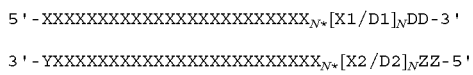

wherein "X"=RNA, "Y" is an optional overhang domain comprised of 0-10 RNA monomers that are optionally 2'-O-methyl RNA monomers—in certain embodiments, "Y" is an overhang domain comprised of 1-4 RNA monomers that are optionally 2'-O-methyl RNA monomers, "D"=DNA, "Z"=DNA or RNA, and "N"=1 to 50 or more, but is optionally 1-8 or 1-10, where at least one $D1_N$ is present in the top strand and is base paired with a corresponding $D2_N$ in the bottom strand. Optionally, $D1_N$ and $D1_{N+1}$ are base paired with corresponding $D2_N$ and $D2_{N+1}$; $D1_N$, $D1_{N+1}$ and $D1_{N+2}$ are base paired with corresponding $D2_N$, $D1_{N+1}$ and $D1_{N+2}$, etc. "N*"=0 to 15 or more, but is optionally 0, 1, 2, 3, 4, 5 or 6. In one embodiment, the top strand is the sense strand, and the bottom strand is the antisense strand. Alternatively, the bottom strand is the sense strand and the top strand is the antisense strand, with 2'-O-methyl RNA monomers located at alternating residues along the top strand, rather than the bottom strand presently depicted in the above schematic.

In the structures depicted herein, the 5' end of either the sense strand or antisense strand can optionally comprise a phosphate group.

In another embodiment, a DNA:DNA-extended DsiRNA comprises strands having equal lengths possessing 1-3 mismatched residues that serve to orient Dicer cleavage (specifically, one or more of positions 1, 2 or 3 on the first strand of the DsiRNA, when numbering from the 3'-terminal residue, are mismatched with corresponding residues of the 5'-terminal region on the second strand when first and second strands are annealed to one another). An exemplary DNA:DNA-extended DsiRNA agent with two terminal mismatched residues is shown:

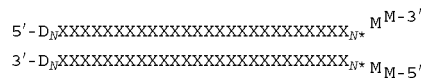

wherein "X"=RNA, "M"=Nucleic acid residues (RNA, DNA or non-natural or modified nucleic acids) that do not base pair (hydrogen bond) with corresponding "M" residues of otherwise complementary strand when strands are annealed, "D"=DNA and "N"=1 to 50 or more, but is optionally 1-15 or, optionally, 1-8. "N*"=0 to 15 or more, but is optionally 0, 1, 2, 3, 4, 5 or 6. Any of the residues of such agents can optionally be 2'-O-methyl RNA monomers—alternating positioning of 2'-O-methyl RNA monomers that commences from the 3'-terminal residue of the bottom (second) strand, as shown for above asymmetric agents, can also be used in the above "blunt/fray" DsiRNA agent. In one embodiment, the top strand (first strand) is the sense strand, and the bottom strand (second strand) is the antisense strand. Alternatively, the bottom strand is the sense strand and the top strand is the antisense strand. Modification and DNA:DNA extension patterns paralleling those shown above for asymmetric/overhang agents can also be incorporated into such "blunt/frayed" agents.

In one embodiment, a length-extended DsiRNA agent is provided that comprises deoxyribonucleotides positioned at sites modeled to function via specific direction of Dicer cleavage, yet which does not require the presence of a base-paired deoxyribonucleotide in the dsRNA structure. An exemplary structure for such a molecule is shown:

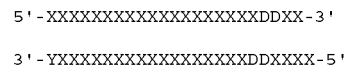

wherein "X"=RNA, "Y" is an optional overhang domain comprised of 0-10 RNA monomers that are optionally 2'-O-methyl RNA monomers—in certain embodiments, "Y" is an overhang domain comprised of 1-4 RNA monomers that are optionally 2'-O-methyl RNA monomers, and "D"=DNA. In one embodiment, the top strand is the sense strand, and the bottom strand is the antisense strand. Alternatively, the bottom strand is the sense strand and the top strand is the antisense strand. The above structure is modeled to force Dicer to cleave a minimum of a 21mer duplex as its primary post-processing form. In embodiments where the bottom strand of the above structure is the antisense strand, the positioning of two deoxyribonucleotide residues at the ultimate and penultimate residues of the 5' end of the antisense strand will help reduce off-target effects (as prior studies have shown a 2'-O-methyl modification of at least the penultimate position from the 5' terminus of the antisense strand to reduce off-target effects; see, e.g., US 2007/0223427).

In one embodiment, the DsiRNA comprises the following (an exemplary "left-extended", "DNA extended" DsiRNA):

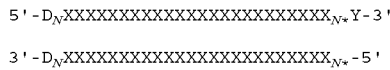

wherein "X"=RNA, "Y" is an optional overhang domain comprised of 0-10 RNA monomers that are optionally 2'-O-methyl RNA monomers—in certain embodiments, "Y" is an overhang domain comprised of 1-4 RNA monomers that are optionally 2'-O-methyl RNA monomers, "D"=DNA, and "N"=1 to 50 or more, but is optionally 1-8 or 1-10. "N*"=0 to 15 or more, but is optionally 0, 1, 2, 3, 4, 5 or 6. In one embodiment, the top strand is the sense strand, and the bottom strand is the antisense strand. Alternatively, the bottom strand is the sense strand and the top strand is the antisense strand.

In a related embodiment, the DsiRNA comprises:

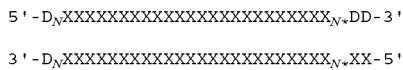

wherein "X"=RNA, optionally a 2'-O-methyl RNA monomers "D"=DNA, "N"=1 to 50 or more, but is optionally 1-8 or 1-10. "N*"=0 to 15 or more, but is optionally 0, 1, 2, 3, 4, 5 or 6. In one embodiment, the top strand is the sense strand, and the bottom strand is the antisense strand. Alternatively, the bottom strand is the sense strand and the top strand is the antisense strand.

In an additional embodiment, the DsiRNA comprises:

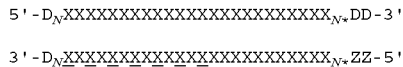

wherein "X"=RNA, optionally a 2'-O-methyl RNA monomers "D"=DNA, "N"=1 to 50 or more, but is optionally 1-8 or 1-10. "N*"=0 to 15 or more, but is optionally 0, 1, 2, 3, 4, 5 or 6. "Z"=DNA or RNA. In one embodiment, the top strand is the sense strand, and the bottom strand is the antisense strand. Alternatively, the bottom strand is the sense strand and the top strand is the antisense strand, with 2'-O-methyl RNA monomers located at alternating residues along the top strand, rather than the bottom strand presently depicted in the above schematic.

In another such embodiment, the DsiRNA comprises:

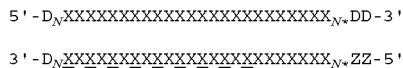

wherein "X"=RNA, optionally a 2'-O-methyl RNA monomers "D"=DNA, "N"=1 to 50 or more, but is optionally 1-8 or 1-10. "N*"=0 to 15 or more, but is optionally 0, 1, 2, 3, 4, 5 or 6. "Z"=DNA or RNA. In one embodiment, the top strand is the sense strand, and the bottom strand is the antisense strand. Alternatively, the bottom strand is the sense strand and the top strand is the antisense strand, with 2'-O-methyl RNA monomers located at alternating residues along the top strand, rather than the bottom strand presently depicted in the above schematic.

In another such embodiment, the DsiRNA comprises:

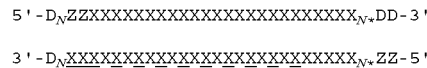

wherein "X"=RNA, "X"=2'-O-methyl RNA, "D"=DNA, "Z"=DNA or RNA, and "N"=1 to 50 or more, but is optionally 1-8 or 1-10. "N*"=0 to 15 or more, but is optionally 0, 1, 2, 3, 4, 5 or 6. In one embodiment, the top strand is the sense strand, and the bottom strand is the antisense strand. Alternatively, the bottom strand is the sense strand and the top strand is the antisense strand, with 2'-O-methyl RNA monomers located at alternating residues along the top strand, rather than the bottom strand presently depicted in the above schematic.

In another such embodiment, the DsiRNA comprises:

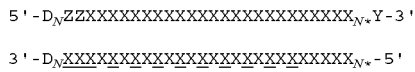

wherein "X"=RNA, "X"=2'-O-methyl RNA, "D"=DNA, "Z"=DNA or RNA, and "N"=1 to 50 or more, but is optionally 1-8 or 1-10. "N*"=0 to 15 or more, but is optionally 0, 1, 2, 3, 4, 5 or 6. "Y" is an optional overhang domain comprised of 0-10 RNA monomers that are optionally 2'-O-methyl RNA monomers—in certain embodiments, "Y" is an overhang domain comprised of 1-4 RNA monomers that are optionally 2'-O-methyl RNA monomers. In one embodiment, the top strand is the sense strand, and the bottom strand is the antisense strand. Alternatively, the bottom strand is the sense strand and the top strand is the antisense strand, with 2'-O-methyl RNA monomers located at alternating residues along the top strand, rather than the bottom strand presently depicted in the above schematic.

In another embodiment, the DsiRNA comprises:

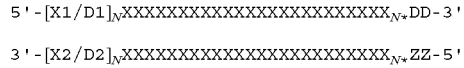

wherein "X"=RNA, "D"=DNA, "Z"=DNA or RNA, and "N"=1 to 50 or more, but is optionally 1-8 or 1-10, where at least one $D1_N$ is present in the top strand and is base paired with a corresponding $D2_N$ in the bottom strand. Optionally, $D1_N$ and $D1_{N+1}$ are base paired with corresponding $D2_N$ and $D2_{N+1}$; $D1_N$, $D1_{N+1}$ and $D1_{N+2}$ are base paired with corresponding $D2_N$, $D1_{N+1}$ and $D1_{N+2}$, etc. "N*"=0 to 15 or more, but is optionally 0, 1, 2, 3, 4, 5 or 6. In one embodiment, the top strand is the sense strand, and the bottom strand is the antisense strand. Alternatively, the bottom strand is the sense strand and the top strand is the antisense strand, with 2'-O-methyl RNA monomers located at alternating residues along the top strand, rather than the bottom strand presently depicted in the above schematic.

In a related embodiment, the DsiRNA comprises:

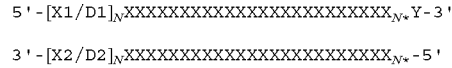

wherein "X"=RNA, "D"=DNA, "Y" is an optional overhang domain comprised of 0-10 RNA monomers that are optionally 2'-O-methyl RNA monomers—in certain embodiments, "Y" is an overhang domain comprised of 1-4 RNA monomers that are optionally 2'-O-methyl RNA monomers, and "N"=1 to 50 or more, but is optionally 1-8 or 1-10, where at least one $D1_N$ is present in the top strand and is base paired with a corresponding $D2_N$ in the bottom strand. Optionally, $D1_N$ and $D1_{N+1}$ are base paired with corresponding $D2_N$ and $D2_{N+1}$; $D1_N$, $D1_{N+1}$ and $D1_{N+2}$ are base paired with corresponding $D2_N$, $D1_{N+1}$ and $D1_{N+2}$, etc. "N*"=0 to 15 or more, but is optionally 0, 1, 2, 3, 4, 5 or 6. In one embodiment, the top strand is the sense strand, and the bottom strand is the antisense strand. Alternatively, the bottom strand is the sense strand and the top strand is the antisense strand, with 2'-O-methyl RNA monomers located at alternating residues along the top strand, rather than the bottom strand presently depicted in the above schematic.

In another embodiment, the DNA:DNA-extended DsiRNA comprises strands having equal lengths possessing 1-3 mismatched residues that serve to orient Dicer cleavage (specifically, one or more of positions 1, 2 or 3 on the first strand of the DsiRNA, when numbering from the 3'-terminal residue, are mismatched with corresponding residues of the 5'-terminal region on the second strand when first and second strands are annealed to one another). An exemplary DNA:DNA-extended DsiRNA agent with two terminal mismatched residues is shown:

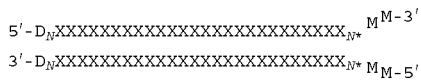

wherein "X"=RNA, "M"=Nucleic acid residues (RNA, DNA or non-natural or modified nucleic acids) that do not base pair (hydrogen bond) with corresponding "M" residues of otherwise complementary strand when strands are annealed, "D"=DNA and "N"=1 to 50 or more, but is optionally 1-8 or 1-10. "N*"=0 to 15 or more, but is optionally 0, 1, 2, 3, 4, 5 or 6. Any of the residues of such agents can optionally be 2'-O-methyl RNA monomers—alternating positioning of 2'-O-methyl RNA monomers that commences from the 3'-terminal residue of the bottom (second) strand, as shown for above asymmetric agents, can also be used in the above "blunt/fray" DsiRNA agent. In one embodiment, the top strand (first strand) is the sense strand, and the bottom strand (second strand) is the antisense strand. Alternatively, the bottom strand is the sense strand and the top strand is the antisense strand. Modification and DNA:DNA extension patterns paralleling those shown above for asymmetric/overhang agents can also be incorporated into such "blunt/frayed" agents.

In another embodiment, a length-extended DsiRNA agent is provided that comprises deoxyribonucleotides positioned at sites modeled to function via specific direction of Dicer cleavage, yet which does not require the presence of a base-paired deoxyribonucleotide in the dsRNA structure. Exemplary structures for such a molecule are shown:

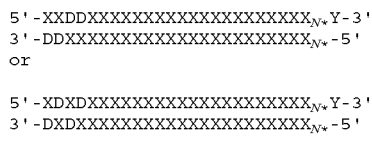

wherein "X"=RNA, "Y" is an optional overhang domain comprised of 0-10 RNA monomers that are optionally 2'-O-methyl RNA monomers—in certain embodiments, "Y" is an overhang domain comprised of 1-4 RNA monomers that are optionally 2'-O-methyl RNA monomers, and "D"=DNA. "N*"=0 to 15 or more, but is optionally 0, 1, 2, 3, 4, 5 or 6. In one embodiment, the top strand is the sense strand, and the bottom strand is the antisense strand. Alternatively, the bottom strand is the sense strand and the top strand is the antisense strand.

In any of the above embodiments where the bottom strand of the above structure is the antisense strand, the positioning of two deoxyribonucleotide residues at the ultimate and penultimate residues of the 5' end of the antisense strand will help reduce off-target effects (as prior studies have shown a 2'-O-methyl modification of at least the penultimate position from the 5' terminus of the antisense strand to reduce off-target effects; see, e.g., US 2007/0223427).

In certain embodiments, the "D" residues of the above structures include at least one PS-DNA or PS-RNA. Optionally, the "D" residues of the above structures include at least one modified nucleotide that inhibits Dicer cleavage.

While the above-described "DNA-extended" DsiRNA agents can be categorized as either "left extended" or "right extended", DsiRNA agents comprising both left- and right-extended DNA-containing sequences within a single agent (e.g., both flanks surrounding a core dsRNA structure are dsDNA extensions) can also be generated and used in similar manner to those described herein for "right-extended" and "left-extended" agents.

In some embodiments, the DsiRNA of the instant invention further comprises a linking moiety or domain that joins the sense and antisense strands of a DNA:DNA-extended DsiRNA agent. Optionally, such a linking moiety domain joins the 3' end of the sense strand and the 5' end of the antisense strand. The linking moiety may be a chemical (non-nucleotide) linker, such as an oligomethylenediol linker, oligoethylene glycol linker, or other art-recognized linker moiety. Alternatively, the linker can be a nucleotide linker, optionally including an extended loop and/or tetraloop.

In one embodiment, the DsiRNA agent has an asymmetric structure, with the sense strand having a 25-base pair length, and the antisense strand having a 27-base pair length with a 1-4 base 3'-overhang (e.g., a one base 3'-overhang, a two base 3'-overhang, a three base 3'-overhang or a four base 3'-overhang). In another embodiment, this DsiRNA agent has an asymmetric structure further containing 2 deoxynucleotides at the 3' end of the sense strand.

In another embodiment, the DsiRNA agent has an asymmetric structure, with the antisense strand having a 25-base pair length, and the sense strand having a 27-base pair length with a 1-4 base 3'-overhang (e.g., a one base 3'-overhang, a two base 3'-overhang, a three base 3'-overhang or a four base 3'-overhang). In another embodiment, this DsiRNA agent has an asymmetric structure further containing 2 deoxyribonucleotides at the 3' end of the antisense strand.

Exemplary α-1 antitrypsin targeting DsiRNA agents of the invention, and their associated α-1 antitrypsin target sequences, include the following, presented in the below series of tables:
Table Number:
(2) Selected Human Anti-α-1 antitrypsin DsiRNA Agents (Asymmetrics);
(3) Selected Human Anti-α-1 antitrypsin DsiRNAs, Unmodified Duplexes (Asymmetrics);
(4) DsiRNA Target Sequences (21mers) in α-1 antitrypsin mRNA;
(5) Selected Human Anti-α-1 antitrypsin "Blunt/Blunt" DsiRNAs; and
(6) DsiRNA Component 19 Nucleotide Target Sequences in α-1 antitrypsin mRNA (7) Additional Human Anti-α-1 antitrypsin DsiRNA Agents (Asymmetrics);
(8) Additional Human Anti-α-1 antitrypsin DsiRNAs, Unmodified Duplexes (Asymmetrics);
(9) Additional DsiRNA Target Sequences (21mers) in α-1 antitrypsin mRNA;
(10) Additional Human Anti-α-1 antitrypsin "Blunt/Blunt" DsiRNAs; and
(11) Additional DsiRNA Component 19 Nucleotide Target Sequences in α-1 antitrypsin mRNA
(12) Further Human Anti-α-1 antitrypsin DsiRNA Agents (Asymmetrics);
(13) Further Human Anti-α-1 antitrypsin DsiRNAs, Unmodified Duplexes (Asymmetrics);
(14) Further DsiRNA Target Sequences (21mers) in α-1 antitrypsin mRNA;
(15) Further Human Anti-α-1 antitrypsin "Blunt/Blunt" DsiRNAs; and
(16) Further DsiRNA Component 19 Nucleotide Target Sequences in α-1 antitrypsin mRNA
(17) Other Human Anti-α-1 antitrypsin DsiRNA Agents (Asymmetrics);
(18) Other Human Anti-α-1 antitrypsin DsiRNAs, Unmodified Duplexes (Asymmetrics);
(19) Other DsiRNA Target Sequences (21mers) in α-1 antitrypsin mRNA;
(20) Other Human Anti-α-1 antitrypsin "Blunt/Blunt" DsiRNAs; and
(21) Other DsiRNA Component 19 Nucleotide Target Sequences in α-1 antitrypsin mRNA

TABLE 2

Selected Human Anti-α-1 antitrypsin DsiRNA Agents (Asymmetrics)

|  |  |  |
| --- | --- | --- |
| | 5'-CAUCCCACCAUGAUCAGGAUCACCcc-3' | (SEQ ID NO: 1) |
| | 3'-AUGUAGGGUGGUACUAGUCCUAGUGGG-5' | (SEQ ID NO: 199) |
| AAT-395 Target: | 5'-TACATCCCACCATGATCAGGATCACCC-3' | (SEQ ID NO: 397) |
| | 5'-CAGCUGGCACACCAGUCCAACAGca-3' | (SEQ ID NO: 2) |
| | 3'-CGGUCGACCGUGUGGUCAGGUUGUCGU-5' | (SEQ ID NO: 200) |
| AAT-475 Target: | 5'-GCCAGCTGGCACACCAGTCCAACAGCA-3' | (SEQ ID NO: 398) |
| | 5'-GCUGGCACACCAGUCCAACAGCAcc-3' | (SEQ ID NO: 3) |
| | 3'-GUCGACCGUGUGGUCAGGUUGUCGUGG-5' | (SEQ ID NO: 201) |
| AAT-477 Target: | 5'-CAGCTGGCACACCAGTCCAACAGCACC-3' | (SEQ ID NO: 399) |
| | 5'-GGCACACCAGUCCAACAGCACCAat-3' | (SEQ ID NO: 4) |
| | 3'-GACCGUGUGGUCAGGUUGUCGUGGUUA-5' | (SEQ ID NO: 202) |
| AAT-480 Target: | 5'-CTGGCACACCAGTCCAACAGCACCAAT-3' | (SEQ ID NO: 400) |
| | 5'-GCACACCAGUCCAACAGCACCAAta-3' | (SEQ ID NO: 5) |
| | 3'-ACCGUGUGGUCAGGUUGUCGUGGUUAU-5' | (SEQ ID NO: 203) |
| AAT-481 Target: | 5'-TGGCACACCAGTCCAACAGCACCAATA-3' | (SEQ ID NO: 401) |
| | 5'-CACACCAGUCCAACAGCACCAAUat-3' | (SEQ ID NO: 6) |
| | 3'-CCGUGUGGUCAGGUUGUCGUGGUUAUA-5' | (SEQ ID NO: 204) |
| AAT-482 Target: | 5'-GGCACACCAGTCCAACAGCACCAATAT-3' | (SEQ ID NO: 402) |
| | 5'-ACACCAGUCCAACAGCACCAAUAtc-3' | (SEQ ID NO: 7) |
| | 3'-CGUGUGGUCAGGUUGUCGUGGUUAUAG-5' | (SEQ ID NO: 205) |
| AAT-483 Target: | 5'-GCACACCAGTCCAACAGCACCAATATC-3' | (SEQ ID NO: 403) |
| | 5'-CACCAGUCCAACAGCACCAAUAUct-3' | (SEQ ID NO: 8) |
| | 3'-GUGUGGUCAGGUUGUCGUGGUUAUAGA-5' | (SEQ ID NO: 206) |
| AAT-484 Target: | 5'-CACACCAGTCCAACAGCACCAATATCT-3' | (SEQ ID NO: 404) |
| | 5'-CCAAUAUCUUCUUCUCCCCAGUGag-3' | (SEQ ID NO: 9) |
| | 3'-GUGGUUAUAGAAGAAGAGGGGUCACUC-5' | (SEQ ID NO: 207) |
| AAT-500 Target: | 5'-CACCAATATCTTCTTCTCCCCAGTGAG-3' | (SEQ ID NO: 405) |
| | 5'-CAAUAUCUUCUUCUCCCCAGUGAgc-3' | (SEQ ID NO: 10) |
| | 3'-UGGUUAUAGAAGAAGAGGGGUCACUCG-5' | (SEQ ID NO: 208) |
| AAT-501 Target: | 5'-ACCAATATCTTCTTCTCCCCAGTGAGC-3' | (SEQ ID NO: 406) |
| | 5'-AAUAUCUUCUUCUCCCCAGUGAGca-3' | (SEQ ID NO: 11) |
| | 3'-GGUUAUAGAAGAAGAGGGGUCACUCGU-5' | (SEQ ID NO: 209) |
| AAT-502 Target: | 5'-CCAATATCTTCTTCTCCCCAGTGAGCA-3' | (SEQ ID NO: 407) |
| | 5'-AUAUCUUCUUCUCCCCAGUGAGCat-3' | (SEQ ID NO: 12) |
| | 3'-GUUAUAGAAGAAGAGGGGUCACUCGUA-5' | (SEQ ID NO: 210) |
| AAT-503 Target: | 5'-CAATATCTTCTTCTCCCCAGTGAGCAT-3' | (SEQ ID NO: 408) |
| | 5'-UAUCUUCUUCUCCCCAGUGAGCAtc-3' | (SEQ ID NO: 13) |
| | 3'-UUAUAGAAGAAGAGGGGUCACUCGUAG-5' | (SEQ ID NO: 211) |
| AAT-504 Target: | 5'-AATATCTTCTTCTCCCCAGTGAGCATC-3' | (SEQ ID NO: 409) |
| | 5'-AUCUUCUUCUCCCCAGUGAGCAUcg-3' | (SEQ ID NO: 14) |
| | 3'-UAUAGAAGAAGAGGGGUCACUCGUAGC-5' | (SEQ ID NO: 212) |
| AAT-505 Target: | 5'-ATATCTTCTTCTCCCCAGTGAGCATCG-3' | (SEQ ID NO: 410) |

TABLE 2-continued

Selected Human Anti-α-1 antitrypsin DsiRNA Agents (Asymmetrics)

```
                5'-UCUUCUUCUCCCCAGUGAGCAUCgc-3'      (SEQ ID NO: 15)
                3'-AUAGAAGAAGAGGGGUCACUCGUAGCG-5'    (SEQ ID NO: 213)
AAT-506 Target: 5'-TATCTTCTTCTCCCCAGTGAGCATCGC-3'    (SEQ ID NO: 411)

5'-CUUCUUCUCCCCAGUGAGCAUCGct-3'      (SEQ ID NO: 16)
                3'-UAGAAGAAGAGGGGUCACUCGUAGCGA-5'    (SEQ ID NO: 214)
AAT-507 Target: 5'-ATCTTCTTCTCCCCAGTGAGCATCGCT-3'    (SEQ ID NO: 412)

5'-UUCUUCUCCCCAGUGAGCAUCGCta-3'      (SEQ ID NO: 17)
                3'-AGAAGAAGAGGGGUCACUCGUAGCGAU-5'    (SEQ ID NO: 215)
AAT-508 Target: 5'-TCTTCTTCTCCCCAGTGAGCATCGCTA-3'    (SEQ ID NO: 413)

5'-UCUUCUCCCCAGUGAGCAUCGCUac-3'      (SEQ ID NO: 18)
                3'-GAAGAAGAGGGGUCACUCGUAGCGAUG-5'    (SEQ ID NO: 216)
AAT-509 Target: 5'-CTTCTTCTCCCCAGTGAGCATCGCTAC-3'    (SEQ ID NO: 414)

5'-CUUCUCCCCAGUGAGCAUCGCUAca-3'      (SEQ ID NO: 19)
                3'-AAGAAGAGGGGUCACUCGUAGCGAUGU-5'    (SEQ ID NO: 217)
AAT-510 Target: 5'-TTCTTCTCCCCAGTGAGCATCGCTACA-3'    (SEQ ID NO: 415)

5'-UCUCCCCAGUGAGCAUCGCUACAgc-3'      (SEQ ID NO: 20)
                3'-GAAGAGGGGUCACUCGUAGCGAUGUCG-5'    (SEQ ID NO: 218)
AAT-512 Target: 5'-CTTCTCCCCAGTGAGCATCGCTACAGC-3'    (SEQ ID NO: 416)

5'-CUCCCCAGUGAGCAUCGCUACAGcc-3'      (SEQ ID NO: 21)
                3'-AAGAGGGGUCACUCGUAGCGAUGUCGG-5'    (SEQ ID NO: 219)
AAT-513 Target: 5'-TTCTCCCCAGTGAGCATCGCTACAGCC-3'    (SEQ ID NO: 417)

5'-CCCCAGUGAGCAUCGCUACAGCCtt-3'      (SEQ ID NO: 22)
                3'-GAGGGGUCACUCGUAGCGAUGUCGGAA-5'    (SEQ ID NO: 220)
AAT-515 Target: 5'-CTCCCCAGTGAGCATCGCTACAGCCTT-3'    (SEQ ID NO: 418)

5'-ACAGCCUUUGCAAUGCUCUCCCUgg-3'      (SEQ ID NO: 23)
                3'-GAUGUCGGAAACGUUACGAGAGGGACC-5'    (SEQ ID NO: 221)
AAT-532 Target: 5'-CTACAGCCTTTGCAATGCTCTCCCTGG-3'    (SEQ ID NO: 419)

5'-UGCAAUGCUCUCCCUGGGGACCAag-3'      (SEQ ID NO: 24)
                3'-AAACGUUACGAGAGGGACCCCUGGUUC-5'    (SEQ ID NO: 222)
AAT-540 Target: 5'-TTTGCAATGCTCTCCCTGGGGACCAAG-3'    (SEQ ID NO: 420)

5'-AAAUCCUGGAGGGCCUGAAUUUCaa-3'      (SEQ ID NO: 25)
                3'-ACUUUAGGACCUCCCGGACUUAAAGUU-5'    (SEQ ID NO: 223)
AAT-581 Target: 5'-TGAAATCCTGGAGGGCCTGAATTTCAA-3'    (SEQ ID NO: 421)

5'-AAUCCUGGAGGGCCUGAAUUUCAac-3'      (SEQ ID NO: 26)
                3'-CUUUAGGACCUCCCGGACUUAAAGUUG-5'    (SEQ ID NO: 224)
AAT-582 Target: 5'-GAAATCCTGGAGGGCCTGAATTTCAAC-3'    (SEQ ID NO: 422)

5'-AUCCUGGAGGGCCUGAAUUUCAAcc-3'      (SEQ ID NO: 27)
                3'-UUUAGGACCUCCCGGACUUAAAGUUGG-5'    (SEQ ID NO: 225)
AAT-583 Target: 5'-AAATCCTGGAGGGCCTGAATTTCAACC-3'    (SEQ ID NO: 423)

5'-CCUGGAGGGCCUGAAUUUCAACCtc-3'      (SEQ ID NO: 28)
                3'-UAGGACCUCCCGGACUUAAAGUUGGAG-5'    (SEQ ID NO: 226)
AAT-585 Target: 5'-ATCCTGGAGGGCCTGAATTTCAACCTC-3'    (SEQ ID NO: 424)

5'-CUGGAGGGCCUGAAUUUCAACCUca-3'      (SEQ ID NO: 29)
                3'-AGGACCUCCCGGACUUAAAGUUGGAGU-5'    (SEQ ID NO: 227)
AAT-586 Target: 5'-TCCTGGAGGGCCTGAATTTCAACCTCA-3'    (SEQ ID NO: 425)

5'-UGGAGGGCCUGAAUUUCAACCUCac-3'      (SEQ ID NO: 30)
                3'-GGACCUCCCGGACUUAAAGUUGGAGUG-5'    (SEQ ID NO: 228)
AAT-587 Target: 5'-CCTGGAGGGCCTGAATTTCAACCTCAC-3'    (SEQ ID NO: 426)

5'-CAUGAAGGCUUCCAGGAACUCCUcc-3'      (SEQ ID NO: 31)
                3'-AGGUACUUCCGAAGGUCCUUGAGGAGG-5'    (SEQ ID NO: 229)
AAT-634 Target: 5'-TCCATGAAGGCTTCCAGGAACTCCTCC-3'    (SEQ ID NO: 427)

5'-GAAGGCUUCCAGGAACUCCUCCGta-3'      (SEQ ID NO: 32)
                3'-UACUUCCGAAGGUCCUUGAGGAGGCAU-5'    (SEQ ID NO: 230)
AAT-637 Target: 5'-ATGAAGGCTTCCAGGAACTCCTCCGTA-3'    (SEQ ID NO: 428)

5'-AAGGCUUCCAGGAACUCCUCCGUac-3'      (SEQ ID NO: 33)
                3'-ACUUCCGAAGGUCCUUGAGGAGGCAUG-5'    (SEQ ID NO: 231)
AAT-638 Target: 5'-TGAAGGCTTCCAGGAACTCCTCCGTAC-3'    (SEQ ID NO: 429)
```

TABLE 2-continued

Selected Human Anti-α-1 antitrypsin DsiRNA Agents (Asymmetrics)

```
                 5'-AGCCAGACAGCCAGCUCCAGCUGac-3'       (SEQ ID NO: 34)
                 3'-GGUCGGUCUGUCGGUCGAGGUCGACUG-5'     (SEQ ID NO: 232)
AAT-671 Target:  5'-CCAGCCAGACAGCCAGCTCCAGCTGAC-3'     (SEQ ID NO: 430)

5'-CCAGACAGCCAGCUCCAGCUGACca-3'       (SEQ ID NO: 35)
                 3'-UCGGUCUGUCGGUCGAGGUCGACUGGU-5'     (SEQ ID NO: 233)
AAT-673 Target:  5'-AGCCAGACAGCCAGCTCCAGCTGACCA-3'     (SEQ ID NO: 431)

5'-AGACAGCCAGCUCCAGCUGACCAcc-3'       (SEQ ID NO: 36)
                 3'-GGUCUGUCGGUCGAGGUCGACUGGUGG-5'     (SEQ ID NO: 234)
AAT-675 Target:  5'-CCAGACAGCCAGCTCCAGCTGACCACC-3'     (SEQ ID NO: 432)

5'-GACAGCCAGCUCCAGCUGACCACcg-3'       (SEQ ID NO: 37)
                 3'-GUCUGUCGGUCGAGGUCGACUGGUGGC-5'     (SEQ ID NO: 235)
AAT-676 Target:  5'-CAGACAGCCAGCTCCAGCTGACCACCG-3'     (SEQ ID NO: 433)

5'-UAGUGGAUAAGUUUUUGGAGGAUgt-3'       (SEQ ID NO: 38)
                 3'-CGAUCACCUAUUCAAAAACCUCCUACA-5'     (SEQ ID NO: 236)
AAT-734 Target:  5'-GCTAGTGGATAAGTTTTTGGAGGATGT-3'     (SEQ ID NO: 434)

5'-AGUGGAUAAGUUUUUGGAGGAUGtt-3'       (SEQ ID NO: 39)
                 3'-GAUCACCUAUUCAAAAACCUCCUACAA-5'     (SEQ ID NO: 237)
AAT-735 Target:  5'-CTAGTGGATAAGTTTTTGGAGGATGTT-3'     (SEQ ID NO: 435)

5'-GUGGAUAAGUUUUUGGAGGAUGUta-3'       (SEQ ID NO: 40)
                 3'-AUCACCUAUUCAAAAACCUCCUACAAU-5'     (SEQ ID NO: 238)
AAT-736 Target:  5'-TAGTGGATAAGTTTTTGGAGGATGTTA-3'     (SEQ ID NO: 436)

5'-UGGAUAAGUUUUUGGAGGAUGUUaa-3'       (SEQ ID NO: 41)
                 3'-UCACCUAUUCAAAAACCUCCUACAAUU-5'     (SEQ ID NO: 239)
AAT-737 Target:  5'-AGTGGATAAGTTTTTGGAGGATGTTAA-3'     (SEQ ID NO: 437)

5'-GGAUAAGUUUUUGGAGGAUGUUAaa-3'       (SEQ ID NO: 42)
                 3'-CACCUAUUCAAAAACCUCCUACAAUUU-5'     (SEQ ID NO: 240)
AAT-738 Target:  5'-GTGGATAAGTTTTTGGAGGATGTTAAA-3'     (SEQ ID NO: 438)

5'-GAUAAGUUUUUGGAGGAUGUUAAaa-3'       (SEQ ID NO: 43)
                 3'-ACCUAUUCAAAAACCUCCUACAAUUUU-5'     (SEQ ID NO: 241)
AAT-739 Target:  5'-TGGATAAGTTTTTGGAGGATGTTAAAA-3'     (SEQ ID NO: 439)

5'-AUAAGUUUUUGGAGGAUGUUAAAaa-3'       (SEQ ID NO: 44)
                 3'-CCUAUUCAAAAACCUCCUACAAUUUUU-5'     (SEQ ID NO: 242)
AAT-740 Target:  5'-GGATAAGTTTTTGGAGGATGTTAAAAA-3'     (SEQ ID NO: 440)

5'-UGUACCACUCAGAAGCCUUCACUgt-3'       (SEQ ID NO: 45)
                 3'-CAACAUGGUGAGUCUUCGGAAGUGACA-5'     (SEQ ID NO: 243)
AAT-767 Target:  5'-GTTGTACCACTCAGAAGCCTTCACTGT-3'     (SEQ ID NO: 441)

5'-GUACCACUCAGAAGCCUUCACUGtc-3'       (SEQ ID NO: 46)
                 3'-AACAUGGUGAGUCUUCGGAAGUGACAG-5'     (SEQ ID NO: 244)
AAT-768 Target:  5'-TTGTACCACTCAGAAGCCTTCACTGTC-3'     (SEQ ID NO: 442)

5'-ACUCAAGGGAAAAUUGUGGAUUUGg-3'       (SEQ ID NO: 47)
                 3'-CAUGAGUUCCCUUUUAACACCUAAACC-5'     (SEQ ID NO: 245)
AAT-850 Target:  5'-GTACTCAAGGGAAAATTGTGGATTTGG-3'     (SEQ ID NO: 443)

5'-CUCAAGGGAAAAUUGUGGAUUUGgt-3'       (SEQ ID NO: 48)
                 3'-AUGAGUUCCCUUUUAACACCUAAACCA-5'     (SEQ ID NO: 246)
AAT-851 Target:  5'-TACTCAAGGGAAAATTGTGGATTTGGT-3'     (SEQ ID NO: 444)

5'-UCAAGGGAAAAUUGUGGAUUUGGtc-3'       (SEQ ID NO: 49)
                 3'-UGAGUUCCCUUUUAACACCUAAACCAG-5'     (SEQ ID NO: 247)
AAT-852 Target:  5'-ACTCAAGGGAAAATTGTGGATTTGGTC-3'     (SEQ ID NO: 445)

5'-CAAGGGAAAAUUGUGGAUUUGGUca-3'       (SEQ ID NO: 50)
                 3'-GAGUUCCCUUUUAACACCUAAACCAGU-5'     (SEQ ID NO: 248)
AAT-853 Target:  5'-CTCAAGGGAAAATTGTGGATTTGGTCA-3'     (SEQ ID NO: 446)

5'-AAGGGAAAAUUGUGGAUUUGGUCaa-3'       (SEQ ID NO: 51)
                 3'-AGUUCCCUUUUAACACCUAAACCAGUU-5'     (SEQ ID NO: 249)
AAT-854 Target:  5'-TCAAGGGAAAATTGTGGATTTGGTCAA-3'     (SEQ ID NO: 447)

5'-AGGGAAAAUUGUGGAUUUGGUCAag-3'       (SEQ ID NO: 52)
                 3'-GUUCCCUUUUAACACCUAAACCAGUUC-5'     (SEQ ID NO: 250)
AAT-855 Target:  5'-CAAGGGAAAATTGTGGATTTGGTCAAG-3'     (SEQ ID NO: 448)
```

TABLE 2-continued

Selected Human Anti-α-1 antitrypsin DsiRNA Agents (Asymmetrics)

```
               5'-GGGAAAAUUGUGGAUUUGGUCAAgg-3'      (SEQ ID NO: 53)
               3'-UUCCCUUUUAACACCUAAACCAGUUCC-5'    (SEQ ID NO: 251)
AAT-856 Target: 5'-AAGGGAAAATTGTGGATTTGGTCAAGG-3'   (SEQ ID NO: 449)

5'-GGAAAAUUGUGGAUUUGGUCAAGga-3'      (SEQ ID NO: 54)
               3'-UCCCUUUUAACACCUAAACCAGUUCCU-5'    (SEQ ID NO: 252)
AAT-857 Target: 5'-AGGGAAAATTGTGGATTTGGTCAAGGA-3'   (SEQ ID NO: 450)

5'-GAAAAUUGUGGAUUUGGUCAAGGag-3'      (SEQ ID NO: 55)
               3'-CCCUUUUAACACCUAAACCAGUUCCUC-5'    (SEQ ID NO: 253)
AAT-858 Target: 5'-GGGAAAATTGTGGATTTGGTCAAGGAG-3'   (SEQ ID NO: 451)

5'-AAAAUUGUGGAUUUGGUCAAGGAgc-3'      (SEQ ID NO: 56)
               3'-CCUUUUAACACCUAAACCAGUUCCUCG-5'    (SEQ ID NO: 254)
AAT-859 Target: 5'-GGAAAATTGTGGATTTGGTCAAGGAGC-3'   (SEQ ID NO: 452)

5'-AAAUUGUGGAUUUGGUCAAGGAGct-3'      (SEQ ID NO: 57)
               3'-CUUUUAACACCUAAACCAGUUCCUCGA-5'    (SEQ ID NO: 255)
AAT-860 Target: 5'-GAAAATTGTGGATTTGGTCAAGGAGCT-3'   (SEQ ID NO: 453)

5'-AAUUGUGGAUUUGGUCAAGGAGCtt-3'      (SEQ ID NO: 58)
               3'-UUUUAACACCUAAACCAGUUCCUCGAA-5'    (SEQ ID NO: 256)
AAT-861 Target: 5'-AAAATTGTGGATTTGGTCAAGGAGCTT-3'   (SEQ ID NO: 454)

5'-AUUGUGGAUUUGGUCAAGGAGCUtg-3'      (SEQ ID NO: 59)
               3'-UUUAACACCUAAACCAGUUCCUCGAAC-5'    (SEQ ID NO: 257)
AAT-862 Target: 5'-AAATTGTGGATTTGGTCAAGGAGCTTG-3'   (SEQ ID NO: 455)

5'-UUGUGGAUUUGGUCAAGGAGCUUga-3'      (SEQ ID NO: 60)
               3'-UUAACACCUAAACCAGUUCCUCGAACU-5'    (SEQ ID NO: 258)
AAT-863 Target: 5'-AATTGTGGATTTGGTCAAGGAGCTTGA-3'   (SEQ ID NO: 456)

5'-UGUGGAUUUGGUCAAGGAGCUUGac-3'      (SEQ ID NO: 61)
               3'-UAACACCUAAACCAGUUCCUCGAACUG-5'    (SEQ ID NO: 259)
AAT-864 Target: 5'-ATTGTGGATTTGGTCAAGGAGCTTGAC-3'   (SEQ ID NO: 457)

5'-GUGGAUUUGGUCAAGGAGCUUGAca-3'      (SEQ ID NO: 62)
               3'-AACACCUAAACCAGUUCCUCGAACUGU-5'    (SEQ ID NO: 260)
AAT-865 Target: 5'-TTGTGGATTTGGTCAAGGAGCTTGACA-3'   (SEQ ID NO: 458)

5'-UGGAUUUGGUCAAGGAGCUUGACag-3'      (SEQ ID NO: 63)
               3'-ACACCUAAACCAGUUCCUCGAACUGUC-5'    (SEQ ID NO: 261)
AAT-866 Target: 5'-TGTGGATTTGGTCAAGGAGCTTGACAG-3'   (SEQ ID NO: 459)

5'-GGAUUUGGUCAAGGAGCUUGACAga-3'      (SEQ ID NO: 64)
               3'-CACCUAAACCAGUUCCUCGAACUGUCU-5'    (SEQ ID NO: 262)
AAT-867 Target: 5'-GTGGATTTGGTCAAGGAGCTTGACAGA-3'   (SEQ ID NO: 460)

5'-GAUUUGGUCAAGGAGCUUGACAGag-3'      (SEQ ID NO: 65)
               3'-ACCUAAACCAGUUCCUCGAACUGUCUC-5'    (SEQ ID NO: 263)
AAT-868 Target: 5'-TGGATTTGGTCAAGGAGCTTGACAGAG-3'   (SEQ ID NO: 461)

5'-AUUUGGUCAAGGAGCUUGACAGAga-3'      (SEQ ID NO: 66)
               3'-CCUAAACCAGUUCCUCGAACUGUCUCU-5'    (SEQ ID NO: 264)
AAT-869 Target: 5'-GGATTTGGTCAAGGAGCTTGACAGAGA-3'   (SEQ ID NO: 462)

5'-UUUGGUCAAGGAGCUUGACAGAGac-3'      (SEQ ID NO: 67)
               3'-CUAAACCAGUUCCUCGAACUGUCUCUG-5'    (SEQ ID NO: 265)
AAT-870 Target: 5'-GATTTGGTCAAGGAGCTTGACAGAGAC-3'   (SEQ ID NO: 463)

5'-UUGGUCAAGGAGCUUGACAGAGAca-3'      (SEQ ID NO: 68)
               3'-UAAACCAGUUCCUCGAACUGUCUCUGU-5'    (SEQ ID NO: 266)
AAT-871 Target: 5'-ATTTGGTCAAGGAGCTTGACAGAGACA-3'   (SEQ ID NO: 464)

5'-UGGUCAAGGAGCUUGACAGAGACac-3'      (SEQ ID NO: 69)
               3'-AAACCAGUUCCUCGAACUGUCUCUGUG-5'    (SEQ ID NO: 267)
AAT-872 Target: 5'-TTTGGTCAAGGAGCTTGACAGAGACAC-3'   (SEQ ID NO: 465)

5'-CAGUUUUUGCUCUGGUGAAUUACat-3'      (SEQ ID NO: 70)
               3'-GUGUCAAAAACGAGACCACUUAAUGUA-5'    (SEQ ID NO: 268)
AAT-896 Target: 5'-CACAGTTTTTGCTCTGGTGAATTACAT-3'   (SEQ ID NO: 466)

5'-AGUUUUUGCUCUGGUGAAUUACAtc-3'      (SEQ ID NO: 71)
               3'-UGUCAAAAACGAGACCACUUAAUGUAG-5'    (SEQ ID NO: 269)
AAT-897 Target: 5'-ACAGTTTTTGCTCTGGTGAATTACATC-3'   (SEQ ID NO: 467)
```

TABLE 2-continued

Selected Human Anti-α-1 antitrypsin DsiRNA Agents (Asymmetrics)

```
              5'-GUUUUUGCUCUGGUGAAUUACAUct-3'    (SEQ ID NO: 72)
              3'-GUCAAAAACGAGACCACUUAAUGUAGA-5'  (SEQ ID NO: 270)
AAT-898 Target: 5'-CAGTTTTTGCTCTGGTGAATTACATCT-3' (SEQ ID NO: 468)

5'-UUUUUGCUCUGGUGAAUUACAUCtt-3'    (SEQ ID NO: 73)
              3'-UCAAAAACGAGACCACUUAAUGUAGAA-5'  (SEQ ID NO: 271)
AAT-899 Target: 5'-AGTTTTTGCTCTGGTGAATTACATCTT-3' (SEQ ID NO: 469)

5'-AAAGGCAAAUGGGAGAGACCCUUUtg-3'   (SEQ ID NO: 74)
              3'-AAUUUCCGUUUACCCUCUCUGGGAAAC-5'  (SEQ ID NO: 272)
AAT-928 Target: 5'-TTAAAGGCAAATGGGAGAGACCCTTTG-3'  (SEQ ID NO: 470)

5'-AAGGCAAAUGGGAGAGACCCUUUga-3'    (SEQ ID NO: 75)
              3'-AUUUCCGUUUACCCUCUCUGGGAAACU-5'  (SEQ ID NO: 273)
AAT-929 Target: 5'-TAAAGGCAAATGGGAGAGACCCTTTGA-3'  (SEQ ID NO: 471)

5'-AGGCAAAUGGGAGAGACCCUUUGaa-3'    (SEQ ID NO: 76)
              3'-UUUCCGUUUACCCUCUCUGGGAAACUU-5'  (SEQ ID NO: 274)
AAT-930 Target: 5'-AAAGGCAAATGGGAGAGACCCTTTGAA-3'  (SEQ ID NO: 472)

5'-GGCAAAUGGGAGAGACCCUUUGAag-3'    (SEQ ID NO: 77)
              3'-UUCCGUUUACCCUCUCUGGGAAACUUC-5'  (SEQ ID NO: 275)
AAT-931 Target: 5'-AAGGCAAATGGGAGAGACCCTTTGAAG-3'  (SEQ ID NO: 473)

5'-AGGAAGAGGACUUCCACGUGGACca-3'    (SEQ ID NO: 78)
              3'-GCUCCUUCUCCUGAAGGUGCACCUGGU-5'  (SEQ ID NO: 276)
AAT-968 Target: 5'-CGAGGAAGAGGACTTCCACGTGGACCA-3'  (SEQ ID NO: 474)

5'-GGAAGAGGACUUCCACGUGGACCag-3'    (SEQ ID NO: 79)
              3'-CUCCUUCUCCUGAAGGUGCACCUGGUC-5'  (SEQ ID NO: 277)
AAT-969 Target: 5'-GAGGAAGAGGACTTCCACGTGGACCAG-3'  (SEQ ID NO: 475)

5'-GAAGAGGACUUCCACGUGGACCAgg-3'    (SEQ ID NO: 80)
              3'-UCCUUCUCCUGAAGGUGCACCUGGUCC-5'  (SEQ ID NO: 278)
AAT-970 Target: 5'-AGGAAGAGGACTTCCACGTGGACCAGG-3'  (SEQ ID NO: 476)

5'-AAGAGGACUUCCACGUGGACCAGgt-3'    (SEQ ID NO: 81)
              3'-CCUUCUCCUGAAGGUGCACCUGGUCCA-5'  (SEQ ID NO: 279)
AAT-971 Target: 5'-GGAAGAGGACTTCCACGTGGACCAGGT-3'  (SEQ ID NO: 477)

5'-GAGGACUUCCACGUGGACCAGGUga-3'    (SEQ ID NO: 82)
              3'-UUCUCCUGAAGGUGCACCUGGUCCACU-5'  (SEQ ID NO: 280)
AAT-973 Target: 5'-AAGAGGACTTCCACGTGGACCAGGTGA-3'  (SEQ ID NO: 478)

5'-AGGACUUCCACGUGGACCAGGUGac-3'    (SEQ ID NO: 83)
              3'-UCUCCUGAAGGUGCACCUGGUCCACUG-5'  (SEQ ID NO: 281)
AAT-974 Target: 5'-AGAGGACTTCCACGTGGACCAGGTGAC-3'  (SEQ ID NO: 479)

5'-GACUUCCACGUGGACCAGGUGACca-3'    (SEQ ID NO: 84)
              3'-UCCUGAAGGUGCACCUGGUCCACUGGU-5'  (SEQ ID NO: 282)
AAT-976 Target: 5'-AGGACTTCCACGTGGACCAGGTGACCA-3'  (SEQ ID NO: 480)

5'-GUUUAGGCAUGUUUAACAUCCAGca-3'    (SEQ ID NO: 85)
              3'-CGCAAAUCCGUACAAAUUGUAGGUCGU-5'  (SEQ ID NO: 283)
AAT-1025 Target: 5'-GCGTTTAGGCATGTTTAACATCCAGCA-3' (SEQ ID NO: 481)

5'-UUUAGGCAUGUUUAACAUCCAGCac-3'    (SEQ ID NO: 86)
              3'-GCAAAUCCGUACAAAUUGUAGGUCGUG-5'  (SEQ ID NO: 284)
AAT-1026 Target: 5'-CGTTTAGGCATGTTTAACATCCAGCAC-3' (SEQ ID NO: 482)

5'-GCUGUCCAGCUGGGUGCUGCUGAtg-3'    (SEQ ID NO: 87)
              3'-UUCGACAGGUCGACCCACGACGACUAC-5'  (SEQ ID NO: 285)
AAT-1059 Target: 5'-AAGCTGTCCAGCTGGGTGCTGCTGATG-3' (SEQ ID NO: 483)

5'-CUGUCCAGCUGGGUGCUGCUGAUga-3'    (SEQ ID NO: 88)
              3'-UCGACAGGUCGACCCACGACGACUACU-5'  (SEQ ID NO: 286)
AAT-1060 Target: 5'-AGCTGTCCAGCTGGGTGCTGCTGATGA-3' (SEQ ID NO: 484)

5'-CAAUGCCACCGCCAUCUUCUUCCtg-3'    (SEQ ID NO: 89)
              3'-CCGUUACGGUGGCGGUAGAAGAAGGAC-5'  (SEQ ID NO: 287)
AAT-1095 Target: 5'-GGCAATGCCACCGCCATCTTCTTCCTG-3' (SEQ ID NO: 485)

5'-AAUGCCACCGCCAUCUUCUUCCUgc-3'    (SEQ ID NO: 90)
              3'-CGUUACGGUGGCGGUAGAAGAAGGACG-5'  (SEQ ID NO: 288)
AAT-1096 Target: 5'-GCAATGCCACCGCCATCTTCTTCCTGC-3' (SEQ ID NO: 486)
```

TABLE 2-continued

Selected Human Anti-α-1 antitrypsin DsiRNA Agents (Asymmetrics)

```
                5'-CCACCGCCAUCUUCUUCCUGCCUGa-3'    (SEQ ID NO: 91)
                3'-ACGGUGGCGGUAGAAGAAGGACGGACU-5'  (SEQ ID NO: 289)
AAT-1100 Target: 5'-TGCCACCGCCATCTTCTTCCTGCCTGA-3'  (SEQ ID NO: 487)

5'-CACCGCCAUCUUCUUCCUGCCUGat-3'    (SEQ ID NO: 92)
                3'-CGGUGGCGGUAGAAGAAGGACGGACUA-5'  (SEQ ID NO: 290)
AAT-1101 Target: 5'-GCCACCGCCATCTTCTTCCTGCCTGAT-3'  (SEQ ID NO: 488)

5'-ACCGCCAUCUUCUUCCUGCCUGAtg-3'    (SEQ ID NO: 93)
                3'-GGUGGCGGUAGAAGAAGGACGGACUAC-5'  (SEQ ID NO: 291)
AAT-1102 Target: 5'-CCACCGCCATCTTCTTCCTGCCTGATG-3'  (SEQ ID NO: 489)

5'-CCGCCAUCUUCUUCCUGCCUGAUga-3'    (SEQ ID NO: 94)
                3'-GUGGCGGUAGAAGAAGGACGGACUACU-5'  (SEQ ID NO: 292)
AAT-1103 Target: 5'-CACCGCCATCTTCTTCCTGCCTGATGA-3'  (SEQ ID NO: 490)

5'-CGCCAUCUUCUUCCUGCCUGAUGag-3'    (SEQ ID NO: 95)
                3'-UGGCGGUAGAAGAAGGACGGACUACUC-5'  (SEQ ID NO: 293)
AAT-1104 Target: 5'-ACCGCCATCTTCTTCCTGCCTGATGAG-3'  (SEQ ID NO: 491)

5'-GCCAUCUUCUUCCUGCCUGAUGAgg-3'    (SEQ ID NO: 96)
                3'-GGCGGUAGAAGAAGGACGGACUACUCC-5'  (SEQ ID NO: 294)
AAT-1105 Target: 5'-CCGCCATCTTCTTCCTGCCTGATGAGG-3'  (SEQ ID NO: 492)

5'-AUCUUCUUCCUGCCUGAUGAGGGga-3'    (SEQ ID NO: 97)
                3'-GGUAGAAGAAGGACGGACUACUCCCCU-5'  (SEQ ID NO: 295)
AAT-1108 Target: 5'-CCATCTTCTTCCTGCCTGATGAGGGGA-3'  (SEQ ID NO: 493)

5'-CUUCCUGCCUGAUGAGGGGAAACta-3'    (SEQ ID NO: 98)
                3'-AAGAAGGACGGACUACUCCCCUUUGAU-5'  (SEQ ID NO: 296)
AAT-1113 Target: 5'-TTCTTCCTGCCTGATGAGGGGAAACTA-3'  (SEQ ID NO: 494)

5'-UUCCUGCCUGAUGAGGGGAAACUac-3'    (SEQ ID NO: 99)
                3'-AGAAGGACGGACUACUCCCCUUUGAUG-5'  (SEQ ID NO: 297)
AAT-1114 Target: 5'-TCTTCCTGCCTGATGAGGGGAAACTAC-3'  (SEQ ID NO: 495)

5'-UCCUGCCUGAUGAGGGGAAACUAca-3'    (SEQ ID NO: 100)
                3'-GAAGGACGGACUACUCCCCUUUGAUGU-5'  (SEQ ID NO: 298)
AAT-1115 Target: 5'-CTTCCTGCCTGATGAGGGGAAACTACA-3'  (SEQ ID NO: 496)

5'-CCUGCCUGAUGAGGGGAAACUACag-3'    (SEQ ID NO: 101)
                3'-AAGGACGGACUACUCCCCUUUGAUGUC-5'  (SEQ ID NO: 299)
AAT-1116 Target: 5'-TTCCTGCCTGATGAGGGGAAACTACAG-3'  (SEQ ID NO: 497)

5'-CUGCCUGAUGAGGGGAAACUACAgc-3'    (SEQ ID NO: 102)
                3'-AGGACGGACUACUCCCCUUUGAUGUCG-5'  (SEQ ID NO: 300)
AAT-1117 Target: 5'-TCCTGCCTGATGAGGGGAAACTACAGC-3'  (SEQ ID NO: 498)

5'-UGCCUGAUGAGGGGAAACUACAGca-3'    (SEQ ID NO: 103)
                3'-GGACGGACUACUCCCCUUUGAUGUCGU-5'  (SEQ ID NO: 301)
AAT-1118 Target: 5'-CCTGCCTGATGAGGGGAAACTACAGCA-3'  (SEQ ID NO: 499)

5'-AGCACCUGGAAAAUGAACUCACCca-3'    (SEQ ID NO: 104)
                3'-UGUCGUGGACCUUUUACUUGAGUGGGU-5'  (SEQ ID NO: 302)
AAT-1139 Target: 5'-ACAGCACCTGGAAAATGAACTCACCCA-3'  (SEQ ID NO: 500)

5'-GCACCUGGAAAAUGAACUCACCCac-3'    (SEQ ID NO: 105)
                3'-GUCGUGGACCUUUUACUUGAGUGGGUG-5'  (SEQ ID NO: 303)
AAT-1140 Target: 5'-CAGCACCTGGAAAATGAACTCACCCAC-3'  (SEQ ID NO: 501)

5'-CACCUGGAAAAUGAACUCACCCAcg-3'    (SEQ ID NO: 106)
                3'-UCGUGGACCUUUUACUUGAGUGGGUGC-5'  (SEQ ID NO: 304)
AAT-1141 Target: 5'-AGCACCTGGAAAATGAACTCACCCACG-3'  (SEQ ID NO: 502)

5'-ACCUGGAAAAUGAACUCACCCACga-3'    (SEQ ID NO: 107)
                3'-CGUGGACCUUUUACUUGAGUGGGUGCU-5'  (SEQ ID NO: 305)
AAT-1142 Target: 5'-GCACCTGGAAAATGAACTCACCCACGA-3'  (SEQ ID NO: 503)

5'-CCUGGAAAAUGAACUCACCCACGat-3'    (SEQ ID NO: 108)
                3'-GUGGACCUUUUACUUGAGUGGGUGCUA-5'  (SEQ ID NO: 306)
AAT-1143 Target: 5'-CACCTGGAAAATGAACTCACCCACGAT-3'  (SEQ ID NO: 504)

5'-AUAUCAUCACCAAGUUCCUGGAAaa-3'    (SEQ ID NO: 109)
                3'-GCUAUAGUAGUGGUUCAAGGACCUUUU-5'  (SEQ ID NO: 307)
AAT-1166 Target: 5'-CGATATCATCACCAAGTTCCTGGAAAA-3'  (SEQ ID NO: 505)
```

TABLE 2-continued

Selected Human Anti-α-1 antitrypsin DsiRNA Agents (Asymmetrics)

```
              5'-UAUCAUCACCAAGUUCCUGGAAAat-3'       (SEQ ID NO: 110)
              3'-CUAUAGUAGUGGUUCAAGGACCUUUUA-5'     (SEQ ID NO: 308)
AAT-1167 Target: 5'-GATATCATCACCAAGTTCCTGGAAAAT-3'  (SEQ ID NO: 506)

5'-AUCAUCACCAAGUUCCUGGAAAAtg-3'       (SEQ ID NO: 111)
              3'-UAUAGUAGUGGUUCAAGGACCUUUUAC-5'     (SEQ ID NO: 309)
AAT-1168 Target: 5'-ATATCATCACCAAGTTCCTGGAAAATG-3'  (SEQ ID NO: 507)

5'-UCAUCACCAAGUUCCUGGAAAAUga-3'       (SEQ ID NO: 112)
              3'-AUAGUAGUGGUUCAAGGACCUUUUACU-5'     (SEQ ID NO: 310)
AAT-1169 Target: 5'-TATCATCACCAAGTTCCTGGAAAATGA-3'  (SEQ ID NO: 508)

5'-CAUCACCAAGUUCCUGGAAAAUGaa-3'       (SEQ ID NO: 113)
              3'-UAGUAGUGGUUCAAGGACCUUUUACUU-5'     (SEQ ID NO: 311)
AAT-1170 Target: 5'-ATCATCACCAAGTTCCTGGAAAATGAA-3'  (SEQ ID NO: 509)

5'-AUCACCAAGUUCCUGGAAAAUGAag-3'       (SEQ ID NO: 114)
              3'-AGUAGUGGUUCAAGGACCUUUUACUUC-5'     (SEQ ID NO: 312)
AAT-1171 Target: 5'-TCATCACCAAGTTCCTGGAAAATGAAG-3'  (SEQ ID NO: 510)

5'-UCACCAAGUUCCUGGAAAAUGAAga-3'       (SEQ ID NO: 115)
              3'-GUAGUGGUUCAAGGACCUUUUACUUCU-5'     (SEQ ID NO: 313)
AAT-1172 Target: 5'-CATCACCAAGTTCCTGGAAAATGAAGA-3'  (SEQ ID NO: 511)

5'-CACCAAGUUCCUGGAAAAUGAAGac-3'       (SEQ ID NO: 116)
              3'-UAGUGGUUCAAGGACCUUUUACUUCUG-5'     (SEQ ID NO: 314)
AAT-1173 Target: 5'-ATCACCAAGTTCCTGGAAAATGAAGAC-3'  (SEQ ID NO: 512)

5'-ACCAAGUUCCUGGAAAAUGAAGAca-3'       (SEQ ID NO: 117)
              3'-AGUGGUUCAAGGACCUUUUACUUCUGU-5'     (SEQ ID NO: 315)
AAT-1174 Target: 5'-TCACCAAGTTCCTGGAAAATGAAGACA-3'  (SEQ ID NO: 513)

5'-CCAAGUUCCUGGAAAAUGAAGACag-3'       (SEQ ID NO: 118)
              3'-GUGGUUCAAGGACCUUUUACUUCUGUC-5'     (SEQ ID NO: 316)
AAT-1175 Target: 5'-CACCAAGTTCCTGGAAAATGAAGACAG-3'  (SEQ ID NO: 514)

5'-AGGUCUUCAGCAAUGGGCUGACct-3'        (SEQ ID NO: 119)
              3'-AUUCCAGAAGUCGUUACCCCGACUGGA-5'     (SEQ ID NO: 317)
AAT-1286 Target: 5'-TAAGGTCTTCAGCAATGGGCTGACCT-3'   (SEQ ID NO: 515)

5'-CAAUGGGCUGACCUCUCCGGGGtc-3'        (SEQ ID NO: 120)
              3'-UCGUUACCCCGACUGGAGAGGCCCCAG-5'     (SEQ ID NO: 318)
AAT-1296 Target: 5'-AGCAATGGGCTGACCTCTCCGGGTC-3'    (SEQ ID NO: 516)

5'-AAUGGGGCUGACCUCUCCGGGGUca-3'       (SEQ ID NO: 121)
              3'-CGUUACCCCGACUGGAGAGGCCCCAGU-5'     (SEQ ID NO: 319)
AAT-1297 Target: 5'-GCAATGGGGCTGACCTCTCCGGGGTCA-3'  (SEQ ID NO: 517)

5'-AUGGGGCUGACCUCUCCGGGGUCac-3'       (SEQ ID NO: 122)
              3'-GUUACCCCGACUGGAGAGGCCCCAGUG-5'     (SEQ ID NO: 320)
AAT-1298 Target: 5'-CAATGGGGCTGACCTCTCCGGGGTCAC-3'  (SEQ ID NO: 518)

5'-GAGGAGGCACCCCUGAAGCUCUCCca-3'      (SEQ ID NO: 123)
              3'-GUCUCCUCCGUGGGGACUUCGAGAGGU-5'     (SEQ ID NO: 321)
AAT-1324 Target: 5'-CAGAGGAGGCACCCCTGAAGCTCTCCA-3'  (SEQ ID NO: 519)

5'-GGAGGCACCCCUGAAGCUCUCCAag-3'       (SEQ ID NO: 124)
              3'-CUCCUCCGUGGGGACUUCGAGAGGUUC-5'     (SEQ ID NO: 322)
AAT-1326 Target: 5'-GAGGAGGCACCCCTGAAGCTCTCCAAG-3'  (SEQ ID NO: 520)

5'-CUGAAGCUCUCCAAGGCCGUGCAta-3'       (SEQ ID NO: 125)
              3'-GGGACUUCGAGAGGUUCCGGCACGUAU-5'     (SEQ ID NO: 323)
AAT-1336 Target: 5'-CCCTGAAGCTCTCCAAGGCCGTGCATA-3'  (SEQ ID NO: 521)

5'-CGUGCAUAAGGCUGUGCUGACCAtc-3'       (SEQ ID NO: 126)
              3'-CGGCACGUAUUCCGACACGACUGGUAG-5'     (SEQ ID NO: 324)
AAT-1353 Target: 5'-GCCGTGCATAAGGCTGTGCTGACCATC-3'  (SEQ ID NO: 522)

5'-GUGCAUAAGGCUGUGCUGACCAUcg-3'       (SEQ ID NO: 127)
              3'-GGCACGUAUUCCGACACGACUGGUAGC-5'     (SEQ ID NO: 325)
AAT-1354 Target: 5'-CCGTGCATAAGGCTGTGCTGACCATCG-3'  (SEQ ID NO: 523)

5'-UGCAUAAGGCUGUGCUGACCAUCga-3'       (SEQ ID NO: 128)
              3'-GCACGUAUUCCGACACGACUGGUAGCU-5'     (SEQ ID NO: 326)
AAT-1355 Target: 5'-CGTGCATAAGGCTGTGCTGACCATCGA-3'  (SEQ ID NO: 524)
```

TABLE 2-continued

Selected Human Anti-α-1 antitrypsin DsiRNA Agents (Asymmetrics)

```
                5'-GCAUAAGGCUGUGCUGACCAUCGac-3'     (SEQ ID NO: 129)
                3'-CACGUAUUCCGACACGACUGGUAGCUG-5'   (SEQ ID NO: 327)
AAT-1356 Target: 5'-GTGCATAAGGCTGTGCTGACCATCGAC-3'  (SEQ ID NO: 525)

5'-CAUAAGGCUGUGCUGACCAUCGAcg-3'     (SEQ ID NO: 130)
                3'-ACGUAUUCCGACACGACUGGUAGCUGC-5'   (SEQ ID NO: 328)
AAT-1357 Target: 5'-TGCATAAGGCTGTGCTGACCATCGACG-3'  (SEQ ID NO: 526)

5'-AUAAGGCUGUGCUGACCAUCGACga-3'     (SEQ ID NO: 131)
                3'-CGUAUUCCGACACGACUGGUAGCUGCU-5'   (SEQ ID NO: 329)
AAT-1358 Target: 5'-GCATAAGGCTGTGCTGACCATCGACGA-3'  (SEQ ID NO: 527)

5'-UAAGGCUGUGCUGACCAUCGACGag-3'     (SEQ ID NO: 132)
                3'-GUAUUCCGACACGACUGGUAGCUGCUC-5'   (SEQ ID NO: 330)
AAT-1359 Target: 5'-CATAAGGCTGTGCTGACCATCGACGAG-3'  (SEQ ID NO: 528)

5'-AAGGCUGUGCUGACCAUCGACGAga-3'     (SEQ ID NO: 133)
                3'-UAUUCCGACACGACUGGUAGCUGCUCU-5'   (SEQ ID NO: 331)
AAT-1360 Target: 5'-ATAAGGCTGTGCTGACCATCGACGAGA-3'  (SEQ ID NO: 529)

5'-AGGCUGUGCUGACCAUCGACGAGaa-3'     (SEQ ID NO: 134)
                3'-AUUCCGACACGACUGGUAGCUGCUCUU-5'   (SEQ ID NO: 332)
AAT-1361 Target: 5'-TAAGGCTGTGCTGACCATCGACGAGAA-3'  (SEQ ID NO: 530)

5'-ACUGAAGCUGCUGGGGCCAUGUUtt-3'     (SEQ ID NO: 135)
                3'-CCUGACUUCGACGACCCCGGUACAAAA-5'   (SEQ ID NO: 333)
AAT-1390 Target: 5'-GGACTGAAGCTGCTGGGGCCATGTTTT-3'  (SEQ ID NO: 531)

5'-CUGAAGCUGCUGGGGCCAUGUUUtt-3'     (SEQ ID NO: 136)
                3'-CUGACUUCGACGACCCCGGUACAAAAA-5'   (SEQ ID NO: 334)
AAT-1391 Target: 5'-GACTGAAGCTGCTGGGGCCATGTTTTT-3'  (SEQ ID NO: 532)

5'-UGAAGCUGCUGGGGCCAUGUUUUta-3'     (SEQ ID NO: 137)
                3'-UGACUUCGACGACCCCGGUACAAAAAU-5'   (SEQ ID NO: 335)
AAT-1392 Target: 5'-ACTGAAGCTGCTGGGGCCATGTTTTTA-3'  (SEQ ID NO: 533)

5'-GAAGCUGCUGGGGCCAUGUUUUAag-3'     (SEQ ID NO: 138)
                3'-GACUUCGACGACCCCGGUACAAAAAUC-5'   (SEQ ID NO: 336)
AAT-1393 Target: 5'-CTGAAGCTGCTGGGGCCATGTTTTTAG-3'  (SEQ ID NO: 534)

5'-AAGCUGCUGGGGCCAUGUUUUAga-3'      (SEQ ID NO: 139)
                3'-ACUUCGACGACCCCGGUACAAAAAUCU-5'   (SEQ ID NO: 337)
AAT-1394 Target: 5'-TGAAGCTGCTGGGGCCATGTTTTTAGA-3'  (SEQ ID NO: 535)

5'-AGCUGCUGGGGCCAUGUUUUUAGag-3'     (SEQ ID NO: 140)
                3'-CUUCGACGACCCCGGUACAAAAAUCUC-5'   (SEQ ID NO: 338)
AAT-1395 Target: 5'-GAAGCTGCTGGGGCCATGTTTTTAGAG-3'  (SEQ ID NO: 536)

5'-GCCAUGUUUUUAGAGGCCAUACCca-3'     (SEQ ID NO: 141)
                3'-CCCGGUACAAAAAUCUCCGGUAUGGGU-5'   (SEQ ID NO: 339)
AAT-1405 Target: 5'-GGGCCATGTTTTTAGAGGCCATACCCA-3'  (SEQ ID NO: 537)

5'-CCAUGUUUUUAGAGGCCAUACCCat-3'     (SEQ ID NO: 142)
                3'-CCGGUACAAAAAUCUCCGGUAUGGGUA-5'   (SEQ ID NO: 340)
AAT-1406 Target: 5'-GGCCATGTTTTTAGAGGCCATACCCAT-3'  (SEQ ID NO: 538)

5'-CAUGUUUUUAGAGGCCAUACCCAtg-3'     (SEQ ID NO: 143)
                3'-CGGUACAAAAAUCUCCGGUAUGGGUAC-5'   (SEQ ID NO: 341)
AAT-1407 Target: 5'-GCCATGTTTTTAGAGGCCATACCCATG-3'  (SEQ ID NO: 539)

5'-AUGUUUUUAGAGGCCAUACCCAUgt-3'     (SEQ ID NO: 144)
                3'-GGUACAAAAAUCUCCGGUAUGGGUACA-5'   (SEQ ID NO: 342)
AAT-1408 Target: 5'-CCATGTTTTTAGAGGCCATACCCATGT-3'  (SEQ ID NO: 540)

5'-UGUUUUUAGAGGCCAUACCCAUGtc-3'     (SEQ ID NO: 145)
                3'-GUACAAAAAUCUCCGGUAUGGGUACAG-5'   (SEQ ID NO: 343)
AAT-1409 Target: 5'-CATGTTTTTAGAGGCCATACCCATGTC-3'  (SEQ ID NO: 541)

5'-GUUUUUAGAGGCCAUACCCAUGUct-3'     (SEQ ID NO: 146)
                3'-UACAAAAAUCUCCGGUAUGGGUACAGA-5'   (SEQ ID NO: 344)
AAT-1410 Target: 5'-ATGTTTTTAGAGGCCATACCCATGTCT-3'  (SEQ ID NO: 542)

5'-UUUUUAGAGGCCAUACCCAUGUCta-3'     (SEQ ID NO: 147)
                3'-ACAAAAAUCUCCGGUAUGGGUACAGAU-5'   (SEQ ID NO: 345)
AAT-1411 Target: 5'-TGTTTTTAGAGGCCATACCCATGTCTA-3'  (SEQ ID NO: 543)
```

TABLE 2-continued

Selected Human Anti-α-1 antitrypsin DsiRNA Agents (Asymmetrics)

```
            5'-UUUUAGAGGCCAUACCCAUGUCUat-3'       (SEQ ID NO: 148)
            3'-CAAAAAUCUCCGGUAUGGGUACAGAUA-5'     (SEQ ID NO: 346)
AAT-1412 Target: 5'-GTTTTTAGAGGCCATACCCATGTCTAT-3' (SEQ ID NO: 544)

5'-UUUAGAGGCCAUACCCAUGUCUAtc-3'       (SEQ ID NO: 149)
            3'-AAAAAUCUCCGGUAUGGGUACAGAUAG-5'     (SEQ ID NO: 347)
AAT-1413 Target: 5'-TTTTTAGAGGCCATACCCATGTCTATC-3' (SEQ ID NO: 545)

5'-UUAGAGGCCAUACCCAUGUCUAUcc-3'       (SEQ ID NO: 150)
            3'-AAAAUCUCCGGUAUGGGUACAGAUAGG-5'     (SEQ ID NO: 348)
AAT-1414 Target: 5'-TTTTAGAGGCCATACCCATGTCTATCC-3'  (SEQ ID NO: 546)

5'-UUAGAGGCCAUACCCAUGUCUAUCcc-3'      (SEQ ID NO: 151)
            3'-AAAUCUCCGGUAUGGGUACAGAUAGGG-5'     (SEQ ID NO: 349)
AAT-1415 Target: 5'-TTTAGAGGCCATACCCATGTCTATCCC-3'  (SEQ ID NO: 547)

5'-AGAGGCCAUACCCAUGUCUAUCCcc-3'       (SEQ ID NO: 152)
            3'-AAUCUCCGGUAUGGGUACAGAUAGGGG-5'     (SEQ ID NO: 350)
AAT-1416 Target: 5'-TTAGAGGCCATACCCATGTCTATCCCC-3'  (SEQ ID NO: 548)

5'-GUUCAACAAACCCUUUGUCUUCUta-3'       (SEQ ID NO: 153)
            3'-UUCAAGUUGUUUGGGAAACAGAAGAAU-5'     (SEQ ID NO: 351)
AAT-1452 Target: 5'-AAGTTCAACAAACCCTTTGTCTTCTTA-3'  (SEQ ID NO: 549)

5'-UUCAACAAACCCUUUGUCUUCUAaa-3'       (SEQ ID NO: 154)
            3'-UCAAGUUGUUUGGGAAACAGAAGAAUU-5'     (SEQ ID NO: 352)
AAT-1453 Target: 5'-AGTTCAACAAACCCTTTGTCTTCTTAA-3'  (SEQ ID NO: 550)

5'-UCAACAAACCCUUUGUCUUCUUAat-3'       (SEQ ID NO: 155)
            3'-CAAGUUGUUUGGGAAACAGAAGAAUUA-5'     (SEQ ID NO: 353)
AAT-1454 Target: 5'-GTTCAACAAACCCTTTGTCTTCTTAAT-3'  (SEQ ID NO: 551)

5'-CAACAAACCCUUUGUCUUCUUAAtg-3'       (SEQ ID NO: 156)
            3'-AAGUUGUUUGGGAAACAGAAGAAUUAC-5'     (SEQ ID NO: 354)
AAT-1455 Target: 5'-TTCAACAAACCCTTTGTCTTCTTAATG-3'  (SEQ ID NO: 552)

5'-AACAAACCCUUUGUCUUCUUAAUga-3'       (SEQ ID NO: 157)
            3'-AGUUGUUUGGGAAACAGAAGAAUUACU-5'     (SEQ ID NO: 355)
AAT-1456 Target: 5'-TCAACAAACCCTTTGTCTTCTTAATGA-3'  (SEQ ID NO: 553)

5'-ACAAACCCUUUGUCUUCUUAAUGat-3'       (SEQ ID NO: 158)
            3'-GUUGUUUGGGAAACAGAAGAAUUACUA-5'     (SEQ ID NO: 356)
AAT-1457 Target: 5'-CAACAAACCCTTTGTCTTCTTAATGAT-3'  (SEQ ID NO: 554)

5'-CAAACCCUUUGUCUUCUUAAUGAtt-3'       (SEQ ID NO: 159)
            3'-UUGUUUGGGAAACAGAAGAAUUACUAA-5'     (SEQ ID NO: 357)
AAT-1458 Target: 5'-AACAAACCCTTTGTCTTCTTAATGATT-3'  (SEQ ID NO: 555)

5'-AAACCCUUUGUCUUCUUAAUGAUtg-3'       (SEQ ID NO: 160)
            3'-UGUUUGGGAAACAGAAGAAUUACUAAC-5'     (SEQ ID NO: 358)
AAT-1459 Target: 5'-ACAAACCCTTTGTCTTCTTAATGATTG-3'  (SEQ ID NO: 556)

5'-AACCCUUUGUCUUCUUAAUGAUUga-3'       (SEQ ID NO: 161)
            3'-GUUUGGGAAACAGAAGAAUUACUAACU-5'     (SEQ ID NO: 359)
AAT-1460 Target: 5'-CAAACCCTTTGTCTTCTTAATGATTGA-3'  (SEQ ID NO: 557)

5'-AAUACCAAGUCUCCCCUCUUCAUgg-3'       (SEQ ID NO: 162)
            3'-UUUUAUGGUUCAGAGGGGAGAAGUACC-5'     (SEQ ID NO: 360)
AAT-1489 Target: 5'-AAAATACCAAGTCTCCCCTCTTCATGG-3'  (SEQ ID NO: 558)

5'-AUACCAAGUCUCCCCUCUUCAUGgg-3'       (SEQ ID NO: 163)
            3'-UUUAUGGUUCAGAGGGGAGAAGUACCC-5'     (SEQ ID NO: 361)
AAT-1490 Target: 5'-AAATACCAAGTCTCCCCTCTTCATGGG-3'  (SEQ ID NO: 559)

5'-UACCAAGUCUCCCCUCUUCAUGGga-3'       (SEQ ID NO: 164)
            3'-UUAUGGUUCAGAGGGGAGAAGUACCCU-5'     (SEQ ID NO: 362)
AAT-1491 Target: 5'-AATACCAAGTCTCCCCTCTTCATGGGA-3'  (SEQ ID NO: 560)

5'-ACCAAGUCUCCCCUCUUCAUGGGaa-3'       (SEQ ID NO: 165)
            3'-UAUGGUUCAGAGGGGAGAAGUACCCUU-5'     (SEQ ID NO: 363)
AAT-1492 Target: 5'-ATACCAAGTCTCCCCTCTTCATGGGAA-3'  (SEQ ID NO: 561)

5'-CCAAGUCUCCCCUCUUCAUGGGAaa-3'       (SEQ ID NO: 166)
            3'-AUGGUUCAGAGGGGAGAAGUACCCUUU-5'     (SEQ ID NO: 364)
AAT-1493 Target: 5'-TACCAAGTCTCCCCTCTTCATGGGAAA-3'  (SEQ ID NO: 562)
```

TABLE 2-continued

Selected Human Anti-α-1 antitrypsin DsiRNA Agents (Asymmetrics)

```
              5'-CAAGUCUCCCCUCUUCAUGGGAAaa-3'       (SEQ ID NO: 167)
              3'-UGGUUCAGAGGGGAGAAGUACCCUUUU-5'    (SEQ ID NO: 365)
AAT-1494 Target: 5'-ACCAAGTCTCCCCTCTTCATGGGAAAA-3'  (SEQ ID NO: 563)

5'-AAGUCUCCCCUCUUCAUGGGAAAag-3'      (SEQ ID NO: 168)
              3'-GGUUCAGAGGGGAGAAGUACCCUUUUC-5'    (SEQ ID NO: 366)
AAT-1495 Target: 5'-CCAAGTCTCCCCTCTTCATGGGAAAAG-3' (SEQ ID NO: 564)

5'-AGUCUCCCCUCUUCAUGGGAAAAgt-3'      (SEQ ID NO: 169)
              3'-GUUCAGAGGGGAGAAGUACCCUUUUCA-5'    (SEQ ID NO: 367)
AAT-1496 Target: 5'-CAAGTCTCCCCTCTTCATGGGAAAAGT-3' (SEQ ID NO: 565)

5'-GUCUCCCCUCUUCAUGGGAAAAGtg-3'      (SEQ ID NO: 170)
              3'-UUCAGAGGGGAGAAGUACCCUUUUCAC-5'    (SEQ ID NO: 368)
AAT-1497 Target: 5'-AAGTCTCCCCTCTTCATGGGAAAAGTG-3' (SEQ ID NO: 566)

5'-CUCCCCUCUUCAUGGGAAAAGUGgt-3'      (SEQ ID NO: 171)
              3'-CAGAGGGGAGAAGUACCCUUUUCACCA-5'    (SEQ ID NO: 369)
AAT-1499 Target: 5'-GTCTCCCCTCTTCATGGGAAAAGTGGT-3' (SEQ ID NO: 567)

5'-CCCCUCUUCAUGGGAAAAGUGGUga-3'      (SEQ ID NO: 172)
              3'-GAGGGGAGAAGUACCCUUUUCACCACU-5'    (SEQ ID NO: 370)
AAT-1501 Target: 5'-CTCCCCTCTTCATGGGAAAAGTGGTGA-3' (SEQ ID NO: 568)

5'-CCCUCUUCAUGGGAAAAGUGGUGaa-3'      (SEQ ID NO: 173)
              3'-AGGGGAGAAGUACCCUUUUCACCACUU-5'    (SEQ ID NO: 371)
AAT-1502 Target: 5'-TCCCCTCTTCATGGGAAAAGTGGTGAA-3' (SEQ ID NO: 569)

5'-CCUCUUCAUGGGAAAAGUGGUGAat-3'      (SEQ ID NO: 174)
              3'-GGGGAGAAGUACCCUUUUCACCACUUA-5'    (SEQ ID NO: 372)
AAT-1503 Target: 5'-CCCCTCTTCATGGGAAAAGTGGTGAAT-3' (SEQ ID NO: 570)

5'-CUCUUCAUGGGAAAAGUGGUGAAtc-3'      (SEQ ID NO: 175)
              3'-GGGAGAAGUACCCUUUUCACCACUUAG-5'    (SEQ ID NO: 373)
AAT-1504 Target: 5'-CCCTCTTCATGGGAAAAGTGGTGAATC-3' (SEQ ID NO: 571)

5'-UCUUCAUGGGAAAAGUGGUGAAUcc-3'      (SEQ ID NO: 176)
              3'-GGAGAAGUACCCUUUUCACCACUUAGG-5'    (SEQ ID NO: 374)
AAT-1505 Target: 5'-CCTCTTCATGGGAAAAGTGGTGAATCC-3' (SEQ ID NO: 572)

5'-CUUCAUGGGAAAAGUGGUGAAUCcc-3'      (SEQ ID NO: 177)
              3'-GAGAAGUACCCUUUUCACCACUUAGGG-5'    (SEQ ID NO: 375)
AAT-1506 Target: 5'-CTCTTCATGGGAAAAGTGGTGAATCCC-3' (SEQ ID NO: 573)

5'-UUCAUGGGAAAAGUGGUGAAUCCca-3'      (SEQ ID NO: 178)
              3'-AGAAGUACCCUUUUCACCACUUAGGGU-5'    (SEQ ID NO: 376)
AAT-1507 Target: 5'-TCTTCATGGGAAAAGTGGTGAATCCCA-3' (SEQ ID NO: 574)

5'-UCAUGGGAAAAGUGGUGAAUCCCac-3'      (SEQ ID NO: 179)
              3'-GAAGUACCCUUUUCACCACUUAGGGUG-5'    (SEQ ID NO: 377)
AAT-1508 Target: 5'-CTTCATGGGAAAAGTGGTGAATCCCAC-3' (SEQ ID NO: 575)

5'-CAUGGGAAAAGUGGUGAAUCCCAcc-3'      (SEQ ID NO: 180)
              3'-AAGUACCCUUUUCACCACUUAGGGUGG-5'    (SEQ ID NO: 378)
AAT-1509 Target: 5'-TTCATGGGAAAAGTGGTGAATCCCACC-3' (SEQ ID NO: 576)

5'-AUGGGAAAAGUGGUGAAUCCCACcc-3'      (SEQ ID NO: 181)
              3'-AGUACCCUUUUCACCACUUAGGGUGGG-5'    (SEQ ID NO: 379)
AAT-1510 Target: 5'-TCATGGGAAAAGTGGTGAATCCCACCC-3' (SEQ ID NO: 577)

5'-UGGGAAAAGUGGUGAAUCCCACCca-3'      (SEQ ID NO: 182)
              3'-GUACCCUUUUCACCACUUAGGGUGGGU-5'    (SEQ ID NO: 380)
AAT-1511 Target: 5'-CATGGGAAAAGTGGTGAATCCCACCCA-3' (SEQ ID NO: 578)

5'-GGGAAAAGUGGUGAAUCCCACCCaa-3'      (SEQ ID NO: 183)
              3'-UACCCUUUUCACCACUUAGGGUGGGUU-5'    (SEQ ID NO: 381)
AAT-1512 Target: 5'-ATGGGAAAAGTGGTGAATCCCACCCAA-3' (SEQ ID NO: 579)

5'-GGAAAAGUGGUGAAUCCCACCCAaa-3'      (SEQ ID NO: 184)
              3'-ACCCUUUUCACCACUUAGGGUGGGUUU-5'    (SEQ ID NO: 382)
AAT-1513 Target: 5'-TGGGAAAAGTGGTGAATCCCACCCAAA-3' (SEQ ID NO: 580)

5'-GAAAAGUGGUGAAUCCCACCCAAaa-3'      (SEQ ID NO: 185)
              3'-CCCUUUUCACCACUUAGGGUGGGUUUU-5'    (SEQ ID NO: 383)
AAT-1514 Target: 5'-GGGAAAAGTGGTGAATCCCACCCAAAA-3' (SEQ ID NO: 581)
```

TABLE 2-continued

Selected Human Anti-α-1 antitrypsin DsiRNA Agents (Asymmetrics)

| | | |
|---|---|---|
| AAT-1515 | 5'-AAAAGUGGUGAAUCCCACCCAAAaa-3'<br>3'-CCUUUUCACCACUUAGGGUGGGUUUUU-5'<br>Target: 5'-GGAAAAGTGGTGAATCCCACCCAAAAA-3' | (SEQ ID NO: 186)<br>(SEQ ID NO: 384)<br>(SEQ ID NO: 582) |
| AAT-1516 | 5'-AAAGUGGUGAAUCCCACCCAAAAat-3'<br>3'-CUUUUCACCACUUAGGGUGGGUUUUUA-5'<br>Target: 5'-GAAAAGTGGTGAATCCCACCCAAAAAT-3' | (SEQ ID NO: 187)<br>(SEQ ID NO: 385)<br>(SEQ ID NO: 583) |
| AAT-1517 | 5'-AAGUGGUGAAUCCCACCCAAAAAta-3'<br>3'-UUUUCACCACUUAGGGUGGGUUUUUAU-5'<br>Target: 5'-AAAAGTGGTGAATCCCACCCAAAAATA-3' | (SEQ ID NO: 188)<br>(SEQ ID NO: 386)<br>(SEQ ID NO: 584) |
| AAT-2872 | 5'-CGAUAGUUCAAAAUGGUGAAAUUag-3'<br>3'-AAGCUAUCAAGUUUUACCACUUUAAUC-5'<br>Target: 5'-TTCGATAGTTCAAAATGGTGAAATTAG-3' | (SEQ ID NO: 189)<br>(SEQ ID NO: 387)<br>(SEQ ID NO: 585) |
| AAT-2880 | 5'-CAAAAUGGUGAAAUUAGCAAUUCta-3'<br>3'-AAGUUUUACCACUUUAAUCGUUAAGAU-5'<br>Target: 5'-TTCAAAATGGTGAAATTAGCAATTCTA-3' | (SEQ ID NO: 190)<br>(SEQ ID NO: 388)<br>(SEQ ID NO: 586) |
| AAT-3167 | 5'-UUGGUAUGAUGUUCAAGUUAGAUaa-3'<br>3'-UCAACCAUACUACAAGUUCAAUCUAUU-5'<br>Target: 5'-AGTTGGTATGATGTTCAAGTTAGATAA-3' | (SEQ ID NO: 191)<br>(SEQ ID NO: 389)<br>(SEQ ID NO: 587) |
| AAT-3169 | 5'-GGUAUGAUGUUCAAGUUAGAUAAca-3'<br>3'-AACCAUACUACAAGUUCAAUCUAUUGU-5'<br>Target: 5'-TTGGTATGATGTTCAAGTTAGATAACA-3' | (SEQ ID NO: 192)<br>(SEQ ID NO: 390)<br>(SEQ ID NO: 588) |
| AAT-3170 | 5'-GUAUGAUGUUCAAGUUAGAUAACaa-3'<br>3'-ACCAUACUACAAGUUCAAUCUAUUGUU-5'<br>Target: 5'-TGGTATGATGTTCAAGTTAGATAACAA-3' | (SEQ ID NO: 193)<br>(SEQ ID NO: 391)<br>(SEQ ID NO: 589) |
| AAT-3172 | 5'-AUGAUGUUCAAGUUAGAUAACAAaa-3'<br>3'-CAUACUACAAGUUCAAUCUAUUGUUUU-5'<br>Target: 5'-GTATGATGTTCAAGTTAGATAACAAAA-3' | (SEQ ID NO: 194)<br>(SEQ ID NO: 392)<br>(SEQ ID NO: 590) |
| AAT-3175 | 5'-AUGUUCAAGUUAGAUAACAAAAUgt-3'<br>3'-ACUACAAGUUCAAUCUAUUGUUUUACA-5'<br>Target: 5'-TGATGTTCAAGTTAGATAACAAAATGT-3' | (SEQ ID NO: 195)<br>(SEQ ID NO: 393)<br>(SEQ ID NO: 591) |
| AAT-3180 | 5'-CAAGUUAGAUAACAAAAUGUUUAta-3'<br>3'-AAGUUCAAUCUAUUGUUUUACAAAUAU-5'<br>Target: 5'-TTCAAGTTAGATAACAAAATGTTTATA-3' | (SEQ ID NO: 196)<br>(SEQ ID NO: 394)<br>(SEQ ID NO: 592) |
| AAT-3181 | 5'-AAGUUAGAUAACAAAAUGUUUAUac-3'<br>3'-AGUUCAAUCUAUUGUUUUACAAAUAUG-5'<br>Target: 5'-TCAAGTTAGATAACAAAATGTTTATAC-3' | (SEQ ID NO: 197)<br>(SEQ ID NO: 395)<br>(SEQ ID NO: 593) |
| AAT-3182 | 5'-AGUUAGAUAACAAAAUGUUUAUAcc-3'<br>3'-GUUCAAUCUAUUGUUUUACAAAUAUGG-5'<br>Target: 5'-CAAGTTAGATAACAAAATGTTTATACC-3' | (SEQ ID NO: 198)<br>(SEQ ID NO: 396)<br>(SEQ ID NO: 594) |

TABLE 3

Selected Human Anti-α-1 antitrypsin DsiRNAs, Unmodified Duplexes (Asymmetrics)

| | | |
|---|---|---|
| AAT-395 | 5'-CAUCCCACCAUGAUCAGGAUCACCC-3'<br>3'-AUGUAGGGUGGUACUAGUCCUAGUGGG-5'<br>Target: 5'-TACATCCCACCATGATCAGGATCACCC-3' | (SEQ ID NO: 595)<br>(SEQ ID NO: 199)<br>(SEQ ID NO: 397) |
| AAT-475 | 5'-CAGCUGGCACACCAGUCCAACAGCA-3'<br>3'-CGGUCGACCGUGUGGUCAGGUUGUCGU-5'<br>Target: 5'-GCCAGCTGGCACACCAGTCCAACAGCA-3' | (SEQ ID NO: 596)<br>(SEQ ID NO: 200)<br>(SEQ ID NO: 398) |
| AAT-477 | 5'-GCUGGCACACCAGUCCAACAGCACC-3'<br>3'-GUCGACCGUGUGGUCAGGUUGUCGUGG-5'<br>Target: 5'-CAGCTGGCACACCAGTCCAACAGCACC-3' | (SEQ ID NO: 597)<br>(SEQ ID NO: 201)<br>(SEQ ID NO: 399) |
| AAT-480 | 5'-GGCACACCAGUCCAACAGCACCAAU-3'<br>3'-GACCGUGUGGUCAGGUUGUCGUGGUUA-5'<br>Target: 5'-CTGGCACACCAGTCCAACAGCACCAAT-3' | (SEQ ID NO: 598)<br>(SEQ ID NO: 202)<br>(SEQ ID NO: 400) |

TABLE 3-continued

Selected Human Anti-α-1 antitrypsin DsiRNAs, Unmodified Duplexes
(Asymmetrics)

|  |  |  |
|---|---|---|
|  | 5'-GCACACCAGUCCAACAGCACCAAUA-3' | (SEQ ID NO: 599) |
|  | 3'-ACCGUGUGGUCAGGUUGUCGUGGUUAU-5' | (SEQ ID NO: 203) |
| AAT-481 Target: | 5'-TGGCACACCAGTCCAACAGCACCAATA-3' | (SEQ ID NO: 401) |
|  | 5'-CACACCAGUCCAACAGCACCAAUAU-3' | (SEQ ID NO: 600) |
|  | 3'-CCGUGUGGUCAGGUUGUCGUGGUUAUA-5' | (SEQ ID NO: 204) |
| AAT-482 Target: | 5'-GGCACACCAGTCCAACAGCACCAATAT-3' | (SEQ ID NO: 402) |
|  | 5'-ACACCAGUCCAACAGCACCAAUAUC-3' | (SEQ ID NO: 601) |
|  | 3'-CGUGUGGUCAGGUUGUCGUGGUUAUAG-5' | (SEQ ID NO: 205) |
| AAT-483 Target: | 5'-GCACACCAGTCCAACAGCACCAATATC-3' | (SEQ ID NO: 403) |
|  | 5'-CACCAGUCCAACAGCACCAAUAUCU-3' | (SEQ ID NO: 602) |
|  | 3'-GUGUGGUCAGGUUGUCGUGGUUAUAGA-5' | (SEQ ID NO: 206) |
| AAT-484 Target: | 5'-CACACCAGTCCAACAGCACCAATATCT-3' | (SEQ ID NO: 404) |
|  | 5'-CCAAUAUCUUCUUCUCCCCAGUGAG-3' | (SEQ ID NO: 603) |
|  | 3'-GUGGUUAUAGAAGAAGAGGGGUCACUC-5' | (SEQ ID NO: 207) |
| AAT-500 Target: | 5'-CACCAATATCTTCTTCTCCCCAGTGAG-3' | (SEQ ID NO: 405) |
|  | 5'-CAAUAUCUUCUUCUCCCCAGUGAGC-3' | (SEQ ID NO: 604) |
|  | 3'-UGGUUAUAGAAGAAGAGGGGUCACUCG-5' | (SEQ ID NO: 208) |
| AAT-501 Target: | 5'-ACCAATATCTTCTTCTCCCCAGTGAGC-3' | (SEQ ID NO: 406) |
|  | 5'-AAUAUCUUCUUCUCCCCAGUGAGCA-3' | (SEQ ID NO: 605) |
|  | 3'-GGUUAUAGAAGAAGAGGGGUCACUCGU-5' | (SEQ ID NO: 209) |
| AAT-502 Target: | 5'-CCAATATCTTCTTCTCCCCAGTGAGCA-3' | (SEQ ID NO: 407) |
|  | 5'-AUAUCUUCUUCUCCCCAGUGAGCAU-3' | (SEQ ID NO: 606) |
|  | 3'-GUUAUAGAAGAAGAGGGGUCACUCGUA-5' | (SEQ ID NO: 210) |
| AAT-503 Target: | 5'-CAATATCTTCTTCTCCCCAGTGAGCAT-3' | (SEQ ID NO: 408) |
|  | 5'-UAUCUUCUUCUCCCCAGUGAGCAUC-3' | (SEQ ID NO: 607) |
|  | 3'-UUAUAGAAGAAGAGGGGUCACUCGUAG-5' | (SEQ ID NO: 211) |
| AAT-504 Target: | 5'-AATATCTTCTTCTCCCCAGTGAGCATC-3' | (SEQ ID NO: 409) |
|  | 5'-AUCUUCUUCUCCCCAGUGAGCAUCG-3' | (SEQ ID NO: 608) |
|  | 3'-UAUAGAAGAAGAGGGGUCACUCGUAGC-5' | (SEQ ID NO: 212) |
| AAT-505 Target: | 5'-ATATCTTCTTCTCCCCAGTGAGCATCG-3' | (SEQ ID NO: 410) |
|  | 5'-UCUUCUUCUCCCCAGUGAGCAUCGC-3' | (SEQ ID NO: 609) |
|  | 3'-AUAGAAGAAGAGGGGUCACUCGUAGCG-5' | (SEQ ID NO: 213) |
| AAT-506 Target: | 5'-TATCTTCTTCTCCCCAGTGAGCATCGC-3' | (SEQ ID NO: 411) |
|  | 5'-CUUCUUCUCCCCAGUGAGCAUCGCU-3' | (SEQ ID NO: 610) |
|  | 3'-UAGAAGAAGAGGGGUCACUCGUAGCGA-5' | (SEQ ID NO: 214) |
| AAT-507 Target: | 5'-ATCTTCTTCTCCCCAGTGAGCATCGCT-3' | (SEQ ID NO: 412) |
|  | 5'-UUCUUCUCCCCAGUGAGCAUCGCUA-3' | (SEQ ID NO: 611) |
|  | 3'-AGAAGAAGAGGGGUCACUCGUAGCGAU-5' | (SEQ ID NO: 215) |
| AAT-508 Target: | 5'-TCTTCTTCTCCCCAGTGAGCATCGCTA-3' | (SEQ ID NO: 413) |
|  | 5'-UCUUCUCCCCAGUGAGCAUCGCUAC-3' | (SEQ ID NO: 612) |
|  | 3'-GAAGAAGAGGGGUCACUCGUAGCGAUG-5' | (SEQ ID NO: 216) |
| AAT-509 Target: | 5'-CTTCTTCTCCCCAGTGAGCATCGCTAC-3' | (SEQ ID NO: 414) |
|  | 5'-CUUCUCCCCAGUGAGCAUCGCUACA-3' | (SEQ ID NO: 613) |
|  | 3'-AAGAAGAGGGGUCACUCGUAGCGAUGU-5' | (SEQ ID NO: 217) |
| AAT-510 Target: | 5'-TTCTTCTCCCCAGTGAGCATCGCTACA-3' | (SEQ ID NO: 415) |
|  | 5'-UCUCCCCAGUGAGCAUCGCUACAGC-3' | (SEQ ID NO: 614) |
|  | 3'-GAAGAGGGGUCACUCGUAGCGAUGUCG-5' | (SEQ ID NO: 218) |
| AAT-512 Target: | 5'-CTTCTCCCCAGTGAGCATCGCTACAGC-3' | (SEQ ID NO: 416) |
|  | 5'-CUCCCCAGUGAGCAUCGCUACAGCC-3' | (SEQ ID NO: 615) |
|  | 3'-AAGAGGGGUCACUCGUAGCGAUGUCGG-5' | (SEQ ID NO: 219) |
| AAT-513 Target: | 5'-TTCTCCCCAGTGAGCATCGCTACAGCC-3' | (SEQ ID NO: 417) |
|  | 5'-CCCCAGUGAGCAUCGCUACAGCCUU-3' | (SEQ ID NO: 616) |
|  | 3'-GAGGGGUCACUCGUAGCGAUGUCGGAA-5' | (SEQ ID NO: 220) |
| AAT-515 Target: | 5'-CTCCCCAGTGAGCATCGCTACAGCCTT-3' | (SEQ ID NO: 418) |
|  | 5'-ACAGCCUUUGCAAUGCUCUCCCUGG-3' | (SEQ ID NO: 617) |
|  | 3'-GAUGUCGGAAACGUUACGAGAGGGACC-5' | (SEQ ID NO: 221) |
| AAT-532 Target: | 5'-CTACAGCCTTTGCAATGCTCTCCCTGG-3' | (SEQ ID NO: 419) |

TABLE 3-continued

Selected Human Anti-α-1 antitrypsin DsiRNAs, Unmodified Duplexes
(Asymmetrics)

|  |  |  |
|---|---|---|
| AAT-540 Target: | 5'-UGCAAUGCUCUCCCUGGGGACCAAG-3'<br>3'-AAACGUUACGAGAGGGACCCCUGGUUC-5'<br>5'-TTTGCAATGCTCTCCCTGGGGACCAAG-3' | (SEQ ID NO: 618)<br>(SEQ ID NO: 222)<br>(SEQ ID NO: 420) |
| AAT-581 Target: | 5'-AAAUCCUGGAGGGCCUGAAUUUCAA-3'<br>3'-ACUUUAGGACCUCCCGGACUUAAAGUU-5'<br>5'-TGAAATCCTGGAGGGCCTGAATTTCAA-3' | (SEQ ID NO: 619)<br>(SEQ ID NO: 223)<br>(SEQ ID NO: 421) |
| AAT-582 Target: | 5'-AAUCCUGGAGGGCCUGAAUUUCAAC-3'<br>3'-CUUUAGGACCUCCCGGACUUAAAGUUG-5'<br>5'-GAAATCCTGGAGGGCCTGAATTTCAAC-3' | (SEQ ID NO: 620)<br>(SEQ ID NO: 224)<br>(SEQ ID NO: 422) |
| AAT-583 Target: | 5'-AUCCUGGAGGGCCUGAAUUUCAACC-3'<br>3'-UUUAGGACCUCCCGGACUUAAAGUUGG-5'<br>5'-AAATCCTGGAGGGCCTGAATTTCAACC-3' | (SEQ ID NO: 621)<br>(SEQ ID NO: 225)<br>(SEQ ID NO: 423) |
| AAT-585 Target: | 5'-CCUGGAGGGCCUGAAUUUCAACCUC-3'<br>3'-UAGGACCUCCCGGACUUAAAGUUGGAG-5'<br>5'-ATCCTGGAGGGCCTGAATTTCAACCTC-3' | (SEQ ID NO: 622)<br>(SEQ ID NO: 226)<br>(SEQ ID NO: 424) |
| AAT-586 Target: | 5'-CUGGAGGGCCUGAAUUUCAACCUCA-3'<br>3'-AGGACCUCCCGGACUUAAAGUUGGAGU-5'<br>5'-TCCTGGAGGGCCTGAATTTCAACCTCA-3' | (SEQ ID NO: 623)<br>(SEQ ID NO: 227)<br>(SEQ ID NO: 425) |
| AAT-587 Target: | 5'-UGGAGGGCCUGAAUUUCAACCUCAC-3'<br>3'-GGACCUCCCGGACUUAAAGUUGGAGUG-5'<br>5'-CCTGGAGGGCCTGAATTTCAACCTCAC-3' | (SEQ ID NO: 624)<br>(SEQ ID NO: 228)<br>(SEQ ID NO: 426) |
| AAT-634 Target: | 5'-CAUGAAGGCUUCCAGGAACUCCUCC-3'<br>3'-AGGUACUUCCGAAGGUCCUUGAGGAGG-5'<br>5'-TCCATGAAGGCTTCCAGGAACTCCTCC-3' | (SEQ ID NO: 625)<br>(SEQ ID NO: 229)<br>(SEQ ID NO: 427) |
| AAT-637 Target: | 5'-GAAGGCUUCCAGGAACUCCUCCGUA-3'<br>3'-UACUUCCGAAGGUCCUUGAGGAGGCAU-5'<br>5'-ATGAAGGCTTCCAGGAACTCCTCCGTA-3' | (SEQ ID NO: 626)<br>(SEQ ID NO: 230)<br>(SEQ ID NO: 428) |
| AAT-638 Target: | 5'-AAGGCUUCCAGGAACUCCUCCGUAC-3'<br>3'-ACUUCCGAAGGUCCUUGAGGAGGCAUG-5'<br>5'-TGAAGGCTTCCAGGAACTCCTCCGTAC-3' | (SEQ ID NO: 627)<br>(SEQ ID NO: 231)<br>(SEQ ID NO: 429) |
| AAT-671 Target: | 5'-AGCCAGACAGCCAGCUCCAGCUGAC-3'<br>3'-GGUCGGUCUGUCGGUCGAGGUCGACUG-5'<br>5'-CCAGCCAGACAGCCAGCTCCAGCTGAC-3' | (SEQ ID NO: 628)<br>(SEQ ID NO: 232)<br>(SEQ ID NO: 430) |
| AAT-673 Target: | 5'-CCAGACAGCCAGCUCCAGCUGACCA-3'<br>3'-UCGGUCUGUCGGUCGAGGUCGACUGGU-5'<br>5'-AGCCAGACAGCCAGCTCCAGCTGACCA-3' | (SEQ ID NO: 629)<br>(SEQ ID NO: 233)<br>(SEQ ID NO: 431) |
| AAT-675 Target: | 5'-AGACAGCCAGCUCCAGCUGACCACC-3'<br>3'-GGUCUGUCGGUCGAGGUCGACUGGUGG-5'<br>5'-CCAGACAGCCAGCTCCAGCTGACCACC-3' | (SEQ ID NO: 630)<br>(SEQ ID NO: 234)<br>(SEQ ID NO: 432) |
| AAT-676 Target: | 5'-GACAGCCAGCUCCAGCUGACCACCG-3'<br>3'-GUCUGUCGGUCGAGGUCGACUGGUGGC-5'<br>5'-CAGACAGCCAGCTCCAGCTGACCACCG-3' | (SEQ ID NO: 631)<br>(SEQ ID NO: 235)<br>(SEQ ID NO: 433) |
| AAT-734 Target: | 5'-UAGUGGAUAAGUUUUUGGAGGAUGU-3'<br>3'-CGAUCACCUAUUCAAAAACCUCCUACA-5'<br>5'-GCTAGTGGATAAGTTTTGGAGGATGT-3' | (SEQ ID NO: 632)<br>(SEQ ID NO: 236)<br>(SEQ ID NO: 434) |
| AAT-735 Target: | 5'-AGUGGAUAAGUUUUUGGAGGAUGUU-3'<br>3'-GAUCACCUAUUCAAAAACCUCCUACAA-5'<br>5'-CTAGTGGATAAGTTTTTGGAGGATGTT-3' | (SEQ ID NO: 633)<br>(SEQ ID NO: 237)<br>(SEQ ID NO: 435) |
| AAT-736 Target: | 5'-GUGGAUAAGUUUUUGGAGGAUGUUA-3'<br>3'-AUCACCUAUUCAAAAACCUCCUACAAU-5'<br>5'-TAGTGGATAAGTTTTTGGAGGATGTTA-3' | (SEQ ID NO: 634)<br>(SEQ ID NO: 238)<br>(SEQ ID NO: 436) |
| AAT-737 Target: | 5'-UGGAUAAGUUUUUGGAGGAUGUUAA-3'<br>3'-UCACCUAUUCAAAAACCUCCUACAAUU-5'<br>5'-AGTGGATAAGTTTTTGGAGGATGTTAA-3' | (SEQ ID NO: 635)<br>(SEQ ID NO: 239)<br>(SEQ ID NO: 437) |
| AAT-738 Target: | 5'-GGAUAAGUUUUUGGAGGAUGUUAAA-3'<br>3'-CACCUAUUCAAAAACCUCCUACAAUUU-5'<br>5'-GTGGATAAGTTTTTGGAGGATGTTAAA-3' | (SEQ ID NO: 636)<br>(SEQ ID NO: 240)<br>(SEQ ID NO: 438) |

TABLE 3-continued

Selected Human Anti-α-1 antitrypsin DsiRNAs, Unmodified Duplexes
(Asymmetrics)

```
               5'-GAUAAGUUUUUGGAGGAUGUUAAAA-3'   (SEQ ID NO: 637)
               3'-ACCUAUUCAAAAACCUCCUACAAUUUU-5' (SEQ ID NO: 241)
AAT-739 Target: 5'-TGGATAAGTTTTTGGAGGATGTTAAAA-3' (SEQ ID NO: 439)

5'-AUAAGUUUUUGGAGGAUGUUAAAAA-3'   (SEQ ID NO: 638)
               3'-CCUAUUCAAAAACCUCCUACAAUUUUU-5' (SEQ ID NO: 242)
AAT-740 Target: 5'-GGATAAGTTTTTGGAGGATGTTAAAAA-3' (SEQ ID NO: 440)

5'-UGUACCACUCAGAAGCCUUCACUGU-3'   (SEQ ID NO: 639)
               3'-CAACAUGGUGAGUCUUCGGAAGUGACA-5' (SEQ ID NO: 243)
AAT-767 Target: 5'-GTTGTACCACTCAGAAGCCTTCACTGT-3' (SEQ ID NO: 441)

5'-GUACCACUCAGAAGCCUUCACUGUC-3'   (SEQ ID NO: 640)
               3'-AACAUGGUGAGUCUUCGGAAGUGACAG-5' (SEQ ID NO: 244)
AAT-768 Target: 5'-TTGTACCACTCAGAAGCCTTCACTGTC-3' (SEQ ID NO: 442)

5'-ACUCAAGGGAAAAUUGUGGAUUUGG-3'   (SEQ ID NO: 641)
               3'-CAUGAGUUCCCUUUUAACACCUAAACC-5' (SEQ ID NO: 245)
AAT-850 Target: 5'-GTACTCAAGGGAAAATTGTGGATTTGG-3' (SEQ ID NO: 443)

5'-CUCAAGGGAAAAUUGUGGAUUUGGU-3'   (SEQ ID NO: 642)
               3'-AUGAGUUCCCUUUUAACACCUAAACCA-5' (SEQ ID NO: 246)
AAT-851 Target: 5'-TACTCAAGGGAAAATTGTGGATTTGGT-3' (SEQ ID NO: 444)

5'-UCAAGGGAAAAUUGUGGAUUUGGUC-3'   (SEQ ID NO: 643)
               3'-UGAGUUCCCUUUUAACACCUAAACCAG-5' (SEQ ID NO: 247)
AAT-852 Target: 5'-ACTCAAGGGAAAATTGTGGATTTGGTC-3' (SEQ ID NO: 445)

5'-CAAGGGAAAAUUGUGGAUUUGGUCA-3'   (SEQ ID NO: 644)
               3'-GAGUUCCCUUUUAACACCUAAACCAGU-5' (SEQ ID NO: 248)
AAT-853 Target: 5'-CTCAAGGGAAAATTGTGGATTTGGTCA-3' (SEQ ID NO: 446)

5'-AAGGGAAAAUUGUGGAUUUGGUCAA-3'   (SEQ ID NO: 645)
               3'-AGUUCCCUUUUAACACCUAAACCAGUU-5' (SEQ ID NO: 249)
AAT-854 Target: 5'-TCAAGGGAAAATTGTGGATTTGGTCAA-3' (SEQ ID NO: 447)

5'-AGGGAAAAUUGUGGAUUUGGUCAAG-3'   (SEQ ID NO: 646)
               3'-GUUCCCUUUUAACACCUAAACCAGUUC-5' (SEQ ID NO: 250)
AAT-855 Target: 5'-CAAGGGAAAATTGTGGATTTGGTCAAG-3' (SEQ ID NO: 448)

5'-GGGAAAAUUGUGGAUUUGGUCAAGG-3'   (SEQ ID NO: 647)
               3'-UUCCCUUUUAACACCUAAACCAGUUCC-5' (SEQ ID NO: 251)
AAT-856 Target: 5'-AAGGGAAAATTGTGGATTTGGTCAAGG-3' (SEQ ID NO: 449)

5'-GGAAAAUUGUGGAUUUGGUCAAGGA-3'   (SEQ ID NO: 648)
               3'-UCCCUUUUAACACCUAAACCAGUUCCU-5' (SEQ ID NO: 252)
AAT-857 Target: 5'-AGGGAAAATTGTGGATTTGGTCAAGGA-3' (SEQ ID NO: 450)

5'-GAAAAUUGUGGAUUUGGUCAAGGAG-3'   (SEQ ID NO: 649)
               3'-CCCUUUUAACACCUAAACCAGUUCCUC-5' (SEQ ID NO: 253)
AAT-858 Target: 5'-GGGAAAATTGTGGATTTGGTCAAGGAG-3' (SEQ ID NO: 451)

5'-AAAAUUGUGGAUUUGGUCAAGGAGC-3'   (SEQ ID NO: 650)
               3'-CCUUUUAACACCUAAACCAGUUCCUCG-5' (SEQ ID NO: 254)
AAT-859 Target: 5'-GGAAAATTGTGGATTTGGTCAAGGAGC-3' (SEQ ID NO: 452)

5'-AAAUUGUGGAUUUGGUCAAGGAGCU-3'   (SEQ ID NO: 651)
               3'-CUUUUAACACCUAAACCAGUUCCUCGA-5' (SEQ ID NO: 255)
AAT-860 Target: 5'-GAAAATTGTGGATTTGGTCAAGGAGCT-3' (SEQ ID NO: 453)

5'-AAUUGUGGAUUUGGUCAAGGAGCUU-3'   (SEQ ID NO: 652)
               3'-UUUUAACACCUAAACCAGUUCCUCGAA-5' (SEQ ID NO: 256)
AAT-861 Target: 5'-AAAATTGTGGATTTGGTCAAGGAGCTT-3' (SEQ ID NO: 454)

5'-AUUGUGGAUUUGGUCAAGGAGCUUG-3'   (SEQ ID NO: 653)
               3'-UUUAACACCUAAACCAGUUCCUCGAAC-5' (SEQ ID NO: 257)
AAT-862 Target: 5'-AAATTGTGGATTTGGTCAAGGAGCTTG-3' (SEQ ID NO: 455)

5'-UUGUGGAUUUGGUCAAGGAGCUUGA-3'   (SEQ ID NO: 654)
               3'-UUAACACCUAAACCAGUUCCUCGAACU-5' (SEQ ID NO: 258)
AAT-863 Target: 5'-AATTGTGGATTTGGTCAAGGAGCTTGA-3' (SEQ ID NO: 456)

5'-UGUGGAUUUGGUCAAGGAGCUUGAC-3'   (SEQ ID NO: 655)
               3'-UAACACCUAAACCAGUUCCUCGAACUG-5' (SEQ ID NO: 259)
AAT-864 Target: 5'-ATTGTGGATTTGGTCAAGGAGCTTGAC-3' (SEQ ID NO: 457)
```

TABLE 3-continued

Selected Human Anti-α-1 antitrypsin DsiRNAs, Unmodified Duplexes (Asymmetrics)

| | | |
|---|---|---|
| AAT-865 Target: | 5'-GUGGAUUUGGUCAAGGAGCUUGACA-3'<br>3'-AACACCUAAACCAGUUCCUCGAACUGU-5'<br>5'-TTGTGGATTTGGTCAAGGAGCTTGACA-3' | (SEQ ID NO: 656)<br>(SEQ ID NO: 260)<br>(SEQ ID NO: 458) |
| AAT-866 Target: | 5'-UGGAUUUGGUCAAGGAGCUUGACAG-3'<br>3'-ACACCUAAACCAGUUCCUCGAACUGUC-5'<br>5'-TGTGGATTTGGTCAAGGAGCTTGACAG-3' | (SEQ ID NO: 657)<br>(SEQ ID NO: 261)<br>(SEQ ID NO: 459) |
| AAT-867 Target: | 5'-GGAUUUGGUCAAGGAGCUUGACAGA-3'<br>3'-CACCUAAACCAGUUCCUCGAACUGUCU-5'<br>5'-GTGGATTTGGTCAAGGAGCTTGACAGA-3' | (SEQ ID NO: 658)<br>(SEQ ID NO: 262)<br>(SEQ ID NO: 460) |
| AAT-868 Target: | 5'-GAUUUGGUCAAGGAGCUUGACAGAG-3'<br>3'-ACCUAAACCAGUUCCUCGAACUGUCUC-5'<br>5'-TGGATTTGGTCAAGGAGCTTGACAGAG-3' | (SEQ ID NO: 659)<br>(SEQ ID NO: 263)<br>(SEQ ID NO: 461) |
| AAT-869 Target: | 5'-AUUUGGUCAAGGAGCUUGACAGAGA-3'<br>3'-CCUAAACCAGUUCCUCGAACUGUCUCU-5'<br>5'-GGATTTGGTCAAGGAGCTTGACAGAGA-3' | (SEQ ID NO: 660)<br>(SEQ ID NO: 264)<br>(SEQ ID NO: 462) |
| AAT-870 Target: | 5'-UUUGGUCAAGGAGCUUGACAGAGAC-3'<br>3'-CUAAACCAGUUCCUCGAACUGUCUCUG-5'<br>5'-GATTTGGTCAAGGAGCTTGACAGAGAC-3' | (SEQ ID NO: 661)<br>(SEQ ID NO: 265)<br>(SEQ ID NO: 463) |
| AAT-871 Target: | 5'-UUGGUCAAGGAGCUUGACAGAGACA-3'<br>3'-UAAACCAGUUCCUCGAACUGUCUCUGU-5'<br>5'-ATTTGGTCAAGGAGCTTGACAGAGACA-3' | (SEQ ID NO: 662)<br>(SEQ ID NO: 266)<br>(SEQ ID NO: 464) |
| AAT-872 Target: | 5'-UGGUCAAGGAGCUUGACAGAGACAC-3'<br>3'-AAACCAGUUCCUCGAACUGUCUCUGUG-5'<br>5'-TTTGGTCAAGGAGCTTGACAGAGACAC-3' | (SEQ ID NO: 663)<br>(SEQ ID NO: 267)<br>(SEQ ID NO: 465) |
| AAT-896 Target: | 5'-CAGUUUUUGCUCUGGUGAAUUACAU-3'<br>3'-GUGUCAAAAACGAGACCACUUAAUGUA-5'<br>5'-CACAGTTTTGCTCTGGTGAATTACAT-3' | (SEQ ID NO: 664)<br>(SEQ ID NO: 268)<br>(SEQ ID NO: 466) |
| AAT-897 Target: | 5'-AGUUUUUGCUCUGGUGAAUUACAUC-3'<br>3'-UGUCAAAAACGAGACCACUUAAUGUAG-5'<br>5'-ACAGTTTTGCTCTGGTGAATTACATC-3' | (SEQ ID NO: 665)<br>(SEQ ID NO: 269)<br>(SEQ ID NO: 467) |
| AAT-898 Target: | 5'-GUUUUUGCUCUGGUGAAUUACAUCU-3'<br>3'-GUCAAAAACGAGACCACUUAAUGUAGA-5'<br>5'-CAGTTTTTGCTCTGGTGAATTACATCT-3' | (SEQ ID NO: 666)<br>(SEQ ID NO: 270)<br>(SEQ ID NO: 468) |
| AAT-899 Target: | 5'-UUUUUGCUCUGGUGAAUUACAUCUU-3'<br>3'-UCAAAAACGAGACCACUUAAUGUAGAA-5'<br>5'-AGTTTTTGCTCTGGTGAATTACATCTT-3' | (SEQ ID NO: 667)<br>(SEQ ID NO: 271)<br>(SEQ ID NO: 469) |
| AAT-928 Target: | 5'-AAAGGCAAAUGGGAGAGACCCUUUG-3'<br>3'-AAUUUCCGUUUACCCUCUCUGGGAAAC-5'<br>5'-TTAAAGGCAAATGGGAGAGACCCTTTG-3' | (SEQ ID NO: 668)<br>(SEQ ID NO: 272)<br>(SEQ ID NO: 470) |
| AAT-929 Target: | 5'-AAGGCAAAUGGGAGAGACCCUUUGA-3'<br>3'-AUUUCCGUUUACCCUCUCUGGGAAACU-5'<br>5'-TAAAGGCAAATGGGAGAGACCCTTTGA-3' | (SEQ ID NO: 669)<br>(SEQ ID NO: 273)<br>(SEQ ID NO: 471) |
| AAT-930 Target: | 5'-AGGCAAAUGGGAGAGACCCUUUGAA-3'<br>3'-UUUCCGUUUACCCUCUCUGGGAAACUU-5'<br>5'-AAAGGCAAATGGGAGAGACCCTTTGAA-3' | (SEQ ID NO: 670)<br>(SEQ ID NO: 274)<br>(SEQ ID NO: 472) |
| AAT-931 Target: | 5'-GGCAAAUGGGAGAGACCCUUUGAAG-3'<br>3'-UUCCGUUUACCCUCUCUGGGAAACUUC-5'<br>5'-AAGGCAAATGGGAGAGACCCTTTGAAG-3' | (SEQ ID NO: 671)<br>(SEQ ID NO: 275)<br>(SEQ ID NO: 473) |
| AAT-968 Target: | 5'-AGGAAGAGGACUUCCACGUGGACCA-3'<br>3'-GCUCCUUCUCCUGAAGGUGCACCUGGU-5'<br>5'-CGAGGAAGAGGACTTCCACGTGGACCA-3' | (SEQ ID NO: 672)<br>(SEQ ID NO: 276)<br>(SEQ ID NO: 474) |
| AAT-969 Target: | 5'-GGAAGAGGACUUCCACGUGGACCAG-3'<br>3'-CUCCUUCUCCUGAAGGUGCACCUGGUC-5'<br>5'-GAGGAAGAGGACTTCCACGTGGACCAG-3' | (SEQ ID NO: 673)<br>(SEQ ID NO: 277)<br>(SEQ ID NO: 475) |
| AAT-970 Target: | 5'-GAAGAGGACUUCCACGUGGACCAGG-3'<br>3'-UCCUUCUCCUGAAGGUGCACCUGGUCC-5'<br>5'-AGGAAGAGGACTTCCACGTGGACCAGG-3' | (SEQ ID NO: 674)<br>(SEQ ID NO: 278)<br>(SEQ ID NO: 476) |

TABLE 3-continued

Selected Human Anti-α-1 antitrypsin DsiRNAs, Unmodified Duplexes
(Asymmetrics)

```
                5'-AAGAGGACUUCCACGUGGACCAGGU-3'       (SEQ ID NO: 675)
                3'-CCUUCUCCUGAAGGUGCACCUGGUCCA-5'     (SEQ ID NO: 279)
AAT-971  Target: 5'-GGAAGAGGACTTCCACGTGGACCAGGT-3'    (SEQ ID NO: 477)

5'-GAGGACUUCCACGUGGACCAGGUGA-3'       (SEQ ID NO: 676)
                3'-UUCUCCUGAAGGUGCACCUGGUCCACU-5'     (SEQ ID NO: 280)
AAT-973  Target: 5'-AAGAGGACTTCCACGTGGACCAGGTGA-3'    (SEQ ID NO: 478)

5'-AGGACUUCCACGUGGACCAGGUGAC-3'       (SEQ ID NO: 677)
                3'-UCUCCUGAAGGUGCACCUGGUCCACUG-5'     (SEQ ID NO: 281)
AAT-974  Target: 5'-AGAGGACTTCCACGTGGACCAGGTGAC-3'    (SEQ ID NO: 479)

5'-GACUUCCACGUGGACCAGGUGACCA-3'       (SEQ ID NO: 678)
                3'-UCCUGAAGGUGCACCUGGUCCACUGGU-5'     (SEQ ID NO: 282)
AAT-976  Target: 5'-AGGACTTCCACGTGGACCAGGTGACCA-3'    (SEQ ID NO: 480)

5'-GUUUAGGCAUGUUUAACAUCCAGCA-3'       (SEQ ID NO: 679)
                3'-CGCAAAUCCGUACAAAUUGUAGGUCGU-5'     (SEQ ID NO: 283)
AAT-1025 Target: 5'-GCGTTTAGGCATGTTTAACATCCAGCA-3'    (SEQ ID NO: 481)

5'-UUUAGGCAUGUUUAACAUCCAGCAC-3'       (SEQ ID NO: 680)
                3'-GCAAAUCCGUACAAAUUGUAGGUCGUG-5'     (SEQ ID NO: 284)
AAT-1026 Target: 5'-CGTTTAGGCATGTTTAACATCCAGCAC-3'    (SEQ ID NO: 482)

5'-GCUGUCCAGCUGGGUGCUGCUGAUG-3'       (SEQ ID NO: 681)
                3'-UUCGACAGGUCGACCCACGACGACUAC-5'     (SEQ ID NO: 285)
AAT-1059 Target: 5'-AAGCTGTCCAGCTGGGTGCTGCTGATG-3'    (SEQ ID NO: 483)

5'-CUGUCCAGCUGGGUGCUGCUGAUGA-3'       (SEQ ID NO: 682)
                3'-UCGACAGGUCGACCCACGACGACUACU-5'     (SEQ ID NO: 286)
AAT-1060 Target: 5'-AGCTGTCCAGCTGGGTGCTGCTGATGA-3'    (SEQ ID NO: 484)

5'-CAAUGCCACCGCCAUCUUCUUCCUG-3'       (SEQ ID NO: 683)
                3'-CCGUUACGGUGGCGGUAGAAGAAGGAC-5'     (SEQ ID NO: 287)
AAT-1095 Target: 5'-GGCAATGCCACCGCCATCTTCTTCCTG-3'    (SEQ ID NO: 485)

5'-AAUGCCACCGCCAUCUUCUUCCUGC-3'       (SEQ ID NO: 684)
                3'-CGUUACGGUGGCGGUAGAAGAAGGACG-5'     (SEQ ID NO: 288)
AAT-1096 Target: 5'-GCAATGCCACCGCCATCTTCTTCCTGC-3'    (SEQ ID NO: 486)

5'-CCACCGCCAUCUUCUUCCUGCCUGA-3'       (SEQ ID NO: 685)
                3'-ACGGUGGCGGUAGAAGAAGGACGGACU-5'     (SEQ ID NO: 289)
AAT-1100 Target: 5'-TGCCACCGCCATCTTCTTCCTGCCTGA-3'    (SEQ ID NO: 487)

5'-CACCGCCAUCUUCUUCCUGCCUGAU-3'       (SEQ ID NO: 686)
                3'-CGGUGGCGGUAGAAGAAGGACGGACUA-5'     (SEQ ID NO: 290)
AAT-1101 Target: 5'-GCCACCGCCATCTTCTTCCTGCCTGAT-3'    (SEQ ID NO: 488)

5'-ACCGCCAUCUUCUUCCUGCCUGAUG-3'       (SEQ ID NO: 687)
                3'-GGUGGCGGUAGAAGAAGGACGGACUAC-5'     (SEQ ID NO: 291)
AAT-1102 Target: 5'-CCACCGCCATCTTCTTCCTGCCTGATG-3'    (SEQ ID NO: 489)

5'-CCGCCAUCUUCUUCCUGCCUGAUGA-3'       (SEQ ID NO: 688)
                3'-GUGGCGGUAGAAGAAGGACGGACUACU-5'     (SEQ ID NO: 292)
AAT-1103 Target: 5'-CACCGCCATCTTCTTCCTGCCTGATGA-3'    (SEQ ID NO: 490)

5'-CGCCAUCUUCUUCCUGCCUGAUGAG-3'       (SEQ ID NO: 689)
                3'-UGGCGGUAGAAGAAGGACGGACUACUC-5'     (SEQ ID NO: 293)
AAT-1104 Target: 5'-ACCGCCATCTTCTTCCTGCCTGATGAG-3'    (SEQ ID NO: 491)

5'-GCCAUCUUCUUCCUGCCUGAUGAGG-3'       (SEQ ID NO: 690)
                3'-GGCGGUAGAAGAAGGACGGACUACUCC-5'     (SEQ ID NO: 294)
AAT-1105 Target: 5'-CCGCCATCTTCTTCCTGCCTGATGAGG-3'    (SEQ ID NO: 492)

5'-AUCUUCUUCCUGCCUGAUGAGGGGA-3'       (SEQ ID NO: 691)
                3'-GGUAGAAGAAGGACGGACUACUCCCCU-5'     (SEQ ID NO: 295)
AAT-1108 Target: 5'-CCATCTTCTTCCTGCCTGATGAGGGGA-3'    (SEQ ID NO: 493)

5'-CUUCCUGCCUGAUGAGGGGAAACUA-3'       (SEQ ID NO: 692)
                3'-AAGAAGGACGGACUACUCCCCUUUGAU-5'     (SEQ ID NO: 296)
AAT-1113 Target: 5'-TTCTTCCTGCCTGATGAGGGGAAACTA-3'    (SEQ ID NO: 494)

5'-UUCCUGCCUGAUGAGGGGAAACUAC-3'       (SEQ ID NO: 693)
                3'-AGAAGGACGGACUACUCCCCUUUGAUG-5'     (SEQ ID NO: 297)
AAT-1114 Target: 5'-TCTTCCTGCCTGATGAGGGGAAACTAC-3'    (SEQ ID NO: 495)
```

TABLE 3-continued

Selected Human Anti-α-1 antitrypsin DsiRNAs, Unmodified Duplexes (Asymmetrics)

```
                5'-UCCUGCCUGAUGAGGGGAAACUACA-3'     (SEQ ID NO: 694)
                3'-GAAGGACGGACUACUCCCCUUUGAUGU-5'   (SEQ ID NO: 298)
AAT-1115 Target: 5'-CTTCCTGCCTGATGAGGGGAAACTACA-3'  (SEQ ID NO: 496)

5'-CCUGCCUGAUGAGGGGAAACUACAG-3'     (SEQ ID NO: 695)
                3'-AAGGACGGACUACUCCCCUUUGAUGUC-5'   (SEQ ID NO: 299)
AAT-1116 Target: 5'-TTCCTGCCTGATGAGGGGAAACTACAG-3'  (SEQ ID NO: 497)

5'-CUGCCUGAUGAGGGGAAACUACAGC-3'     (SEQ ID NO: 696)
                3'-AGGACGGACUACUCCCCUUUGAUGUCG-5'   (SEQ ID NO: 300)
AAT-1117 Target: 5'-TCCTGCCTGATGAGGGGAAACTACAGC-3'  (SEQ ID NO: 498)

5'-UGCCUGAUGAGGGGAAACUACAGCA-3'     (SEQ ID NO: 697)
                3'-GGACGGACUACUCCCCUUUGAUGUCGU-5'   (SEQ ID NO: 301)
AAT-1118 Target: 5'-CCTGCCTGATGAGGGGAAACTACAGCA-3'  (SEQ ID NO: 499)

5'-AGCACCUGGAAAAUGAACUCACCCA-3'     (SEQ ID NO: 698)
                3'-UGUCGUGGACCUUUUACUUGAGUGGGU-5'   (SEQ ID NO: 302)
AAT-1139 Target: 5'-ACAGCACCTGGAAAATGAACTCACCCA-3'  (SEQ ID NO: 500)

5'-GCACCUGGAAAAUGAACUCACCCAC-3'     (SEQ ID NO: 699)
                3'-GUCGUGGACCUUUUACUUGAGUGGGUG-5'   (SEQ ID NO: 303)
AAT-1140 Target: 5'-CAGCACCTGGAAAATGAACTCACCCAC-3'  (SEQ ID NO: 501)

5'-CACCUGGAAAAUGAACUCACCCACG-3'     (SEQ ID NO: 700)
                3'-UCGUGGACCUUUUACUUGAGUGGGUGC-5'   (SEQ ID NO: 304)
AAT-1141 Target: 5'-AGCACCTGGAAAATGAACTCACCCACG-3'  (SEQ ID NO: 502)

5'-ACCUGGAAAAUGAACUCACCCACGA-3'     (SEQ ID NO: 701)
                3'-CGUGGACCUUUUACUUGAGUGGGUGCU-5'   (SEQ ID NO: 305)
AAT-1142 Target: 5'-GCACCTGGAAAATGAACTCACCCACGA-3'  (SEQ ID NO: 503)

5'-CCUGGAAAAUGAACUCACCCACGAU-3'     (SEQ ID NO: 702)
                3'-GUGGACCUUUUACUUGAGUGGGUGCUA-5'   (SEQ ID NO: 306)
AAT-1143 Target: 5'-CACCTGGAAAATGAACTCACCCACGAT-3'  (SEQ ID NO: 504)

5'-AUAUCAUCACCAAGUUCCUGGAAAA-3'     (SEQ ID NO: 703)
                3'-GCUAUAGUAGUGGUUCAAGGACCUUUU-5'   (SEQ ID NO: 307)
AAT-1166 Target: 5'-CGATATCATCACCAAGTTCCTGGAAAA-3'  (SEQ ID NO: 505)

5'-UAUCAUCACCAAGUUCCUGGAAAAU-3'     (SEQ ID NO: 704)
                3'-CUAUAGUAGUGGUUCAAGGACCUUUUA-5'   (SEQ ID NO: 308)
AAT-1167 Target: 5'-GATATCATCACCAAGTTCCTGGAAAAT-3'  (SEQ ID NO: 506)

5'-AUCAUCACCAAGUUCCUGGAAAAUG-3'     (SEQ ID NO: 705)
                3'-UAUAGUAGUGGUUCAAGGACCUUUUAC-5'   (SEQ ID NO: 309)
AAT-1168 Target: 5'-ATATCATCACCAAGTTCCTGGAAAATG-3'  (SEQ ID NO: 507)

5'-UCAUCACCAAGUUCCUGGAAAAUGA-3'     (SEQ ID NO: 706)
                3'-AUAGUAGUGGUUCAAGGACCUUUUACU-5'   (SEQ ID NO: 310)
AAT-1169 Target: 5'-TATCATCACCAAGTTCCTGGAAAATGA-3'  (SEQ ID NO: 508)

5'-CAUCACCAAGUUCCUGGAAAAUGAA-3'     (SEQ ID NO: 707)
                3'-UAGUAGUGGUUCAAGGACCUUUUACUU-5'   (SEQ ID NO: 311)
AAT-1170 Target: 5'-ATCATCACCAAGTTCCTGGAAAATGAA-3'  (SEQ ID NO: 509)

5'-AUCACCAAGUUCCUGGAAAAUGAAG-3'     (SEQ ID NO: 708)
                3'-AGUAGUGGUUCAAGGACCUUUUACUUC-5'   (SEQ ID NO: 312)
AAT-1171 Target: 5'-TCATCACCAAGTTCCTGGAAAATGAAG-3'  (SEQ ID NO: 510)

5'-UCACCAAGUUCCUGGAAAAUGAAGA-3'     (SEQ ID NO: 709)
                3'-GUAGUGGUUCAAGGACCUUUUACUUCU-5'   (SEQ ID NO: 313)
AAT-1172 Target: 5'-CATCACCAAGTTCCTGGAAAATGAAGA-3'  (SEQ ID NO: 511)

5'-CACCAAGUUCCUGGAAAAUGAAGAC-3'     (SEQ ID NO: 710)
                3'-UAGUGGUUCAAGGACCUUUUACUUCUG-5'   (SEQ ID NO: 314)
AAT-1173 Target: 5'-ATCACCAAGTTCCTGGAAAATGAAGAC-3'  (SEQ ID NO: 512)

5'-ACCAAGUUCCUGGAAAAUGAAGACA-3'     (SEQ ID NO: 711)
                3'-AGUGGUUCAAGGACCUUUUACUUCUGU-5'   (SEQ ID NO: 315)
AAT-1174 Target: 5'-TCACCAAGTTCCTGGAAAATGAAGACA-3'  (SEQ ID NO: 513)

5'-CCAAGUUCCUGGAAAAUGAAGACAG-3'     (SEQ ID NO: 712)
                3'-GUGGUUCAAGGACCUUUUACUUCUGUC-5'   (SEQ ID NO: 316)
AAT-1175 Target: 5'-CACCAAGTTCCTGGAAAATGAAGACAG-3'  (SEQ ID NO: 514)
```

TABLE 3-continued

Selected Human Anti-α-1 antitrypsin DsiRNAs, Unmodified Duplexes
(Asymmetrics)

```
               5'-AGGUCUUCAGCAAUGGGGCUGACCU-3'    (SEQ ID NO: 713)
               3'-AUUCCAGAAGUCGUUACCCCGACUGGA-5'  (SEQ ID NO: 317)
AAT-1286 Target: 5'-TAAGGTCTTCAGCAATGGGGCTGACCT-3' (SEQ ID NO: 515)

5'-CAAUGGGGCUGACCUCUCCGGGGUC-3'    (SEQ ID NO: 714)
               3'-UCGUUACCCCGACUGGAGAGGCCCCAG-5'  (SEQ ID NO: 318)
AAT-1296 Target: 5'-AGCAATGGGGCTGACCTCTCCGGGGTC-3' (SEQ ID NO: 516)

5'-AAUGGGGCUGACCUCUCCGGGGUCA-3'    (SEQ ID NO: 715)
               3'-CGUUACCCCGACUGGAGAGGCCCCAGU-5'  (SEQ ID NO: 319)
AAT-1297 Target: 5'-GCAATGGGGCTGACCTCTCCGGGGTCA-3' (SEQ ID NO: 517)

5'-AUGGGGCUGACCUCUCCGGGGUCAC-3'    (SEQ ID NO: 716)
               3'-GUUACCCCGACUGGAGAGGCCCCAGUG-5'  (SEQ ID NO: 320)
AAT-1298 Target: 5'-CAATGGGCTGACCTCTCCGGGGTCAC-3'  (SEQ ID NO: 518)

5'-GAGGAGGCACCCCUGAAGCUCUCCA-3'    (SEQ ID NO: 717)
               3'-GUCUCCUCCGUGGGGACUUCGAGAGGU-5'  (SEQ ID NO: 321)
AAT-1324 Target: 5'-CAGAGGAGGCACCCCTGAAGCTCTCCA-3' (SEQ ID NO: 519)

5'-GGAGGCACCCCUGAAGCUCUCCAAG-3'    (SEQ ID NO: 718)
               3'-CUCCUCCGUGGGGACUUCGAGAGGUUC-5'  (SEQ ID NO: 322)
AAT-1326 Target: 5'-GAGGAGGCACCCCTGAAGCTCTCCAAG-3' (SEQ ID NO: 520)

5'-CUGAAGCUCUCCAAGGCCGUGCAUA-3'    (SEQ ID NO: 719)
               3'-GGGACUUCGAGAGGUUCCGGCACGUAU-5'  (SEQ ID NO: 323)
AAT-1336 Target: 5'-CCCTGAAGCTCTCCAAGGCCGTGCATA-3' (SEQ ID NO: 521)

5'-CGUGCAUAAGGCUGUGCUGACCAUC-3'    (SEQ ID NO: 720)
               3'-CGGCACGUAUUCCGACACGACUGGUAG-5'  (SEQ ID NO: 324)
AAT-1353 Target: 5'-GCCGTGCATAAGGCTGTGCTGACCATC-3' (SEQ ID NO: 522)

5'-GUGCAUAAGGCUGUGCUGACCAUCG-3'    (SEQ ID NO: 721)
               3'-GGCACGUAUUCCGACACGACUGGUAGC-5'  (SEQ ID NO: 325)
AAT-1354 Target: 5'-CCGTGCATAAGGCTGTGCTGACCATCG-3' (SEQ ID NO: 523)

5'-UGCAUAAGGCUGUGCUGACCAUCGA-3'    (SEQ ID NO: 722)
               3'-GCACGUAUUCCGACACGACUGGUAGCU-5'  (SEQ ID NO: 326)
AAT-1355 Target: 5'-CGTGCATAAGGCTGTGCTGACCATCGA-3' (SEQ ID NO: 524)

5'-GCAUAAGGCUGUGCUGACCAUCGAC-3'    (SEQ ID NO: 723)
               3'-CACGUAUUCCGACACGACUGGUAGCUG-5'  (SEQ ID NO: 327)
AAT-1356 Target: 5'-GTGCATAAGGCTGTGCTGACCATCGAC-3' (SEQ ID NO: 525)

5'-CAUAAGGCUGUGCUGACCAUCGACG-3'    (SEQ ID NO: 724)
               3'-ACGUAUUCCGACACGACUGGUAGCUGC-5'  (SEQ ID NO: 328)
AAT-1357 Target: 5'-TGCATAAGGCTGTGCTGACCATCGACG-3' (SEQ ID NO: 526)

5'-AUAAGGCUGUGCUGACCAUCGACGA-3'    (SEQ ID NO: 725)
               3'-CGUAUUCCGACACGACUGGUAGCUGCU-5'  (SEQ ID NO: 329)
AAT-1358 Target: 5'-GCATAAGGCTGTGCTGACCATCGACGA-3' (SEQ ID NO: 527)

5'-UAAGGCUGUGCUGACCAUCGACGAG-3'    (SEQ ID NO: 726)
               3'-GUAUUCCGACACGACUGGUAGCUGCUC-5'  (SEQ ID NO: 330)
AAT-1359 Target: 5'-CATAAGGCTGTGCTGACCATCGACGAG-3' (SEQ ID NO: 528)

5'-AAGGCUGUGCUGACCAUCGACGAGA-3'    (SEQ ID NO: 727)
               3'-UAUUCCGACACGACUGGUAGCUGCUCU-5'  (SEQ ID NO: 331)
AAT-1360 Target: 5'-ATAAGGCTGTGCTGACCATCGACGAGA-3' (SEQ ID NO: 529)

5'-AGGCUGUGCUGACCAUCGACGAGAA-3'    (SEQ ID NO: 728)
               3'-AUUCCGACACGACUGGUAGCUGCUCUU-5'  (SEQ ID NO: 332)
AAT-1361 Target: 5'-TAAGGCTGTGCTGACCATCGACGAGAA-3' (SEQ ID NO: 530)

5'-ACUGAAGCUGCUGGGGCCAUGUUUU-3'    (SEQ ID NO: 729)
               3'-CCUGACUUCGACGACCCCGGUACAAAA-5'  (SEQ ID NO: 333)
AAT-1390 Target: 5'-GGACTGAAGCTGCTGGGGCCATGTTTT-3' (SEQ ID NO: 531)

5'-CUGAAGCUGCUGGGGCCAUGUUUUU-3'    (SEQ ID NO: 730)
               3'-CUGACUUCGACGACCCCGGUACAAAAA-5'  (SEQ ID NO: 334)
AAT-1391 Target: 5'-GACTGAAGCTGCTGGGGCCATGTTTTT-3' (SEQ ID NO: 532)

5'-UGAAGCUGCUGGGGCCAUGUUUUUA-3'    (SEQ ID NO: 731)
               3'-UGACUUCGACGACCCCGGUACAAAAAU-5'  (SEQ ID NO: 335)
AAT-1392 Target: 5'-ACTGAAGCTGCTGGGGCCATGTTTTTA-3' (SEQ ID NO: 533)
```

TABLE 3-continued

Selected Human Anti-α-1 antitrypsin DsiRNAs, Unmodified Duplexes
(Asymmetrics)

```
              5'-GAAGCUGCUGGGGCCAUGUUUUUAG-3'       (SEQ ID NO: 732)
              3'-GACUUCGACGACCCCGGUACAAAAAUC-5'     (SEQ ID NO: 336)
AAT-1393 Target: 5'-CTGAAGCTGCTGGGGCCATGTTTTTAG-3'  (SEQ ID NO: 534)

5'-AAGCUGCUGGGGCCAUGUUUUUAGA-3'      (SEQ ID NO: 733)
              3'-ACUUCGACGACCCCGGUACAAAAAUCU-5'    (SEQ ID NO: 337)
AAT-1394 Target: 5'-TGAAGCTGCTGGGGCCATGTTTTTAGA-3' (SEQ ID NO: 535)

5'-AGCUGCUGGGGCCAUGUUUUUAGAG-3'      (SEQ ID NO: 734)
              3'-CUUCGACGACCCCGGUACAAAAAUCUC-5'    (SEQ ID NO: 338)
AAT-1395 Target: 5'-GAAGCTGCTGGGGCCATGTTTTTAGAG-3' (SEQ ID NO: 536)

5'-GCCAUGUUUUUAGAGGCCAUACCCA-3'      (SEQ ID NO: 735)
              3'-CCCGGUACAAAAAUCUCCGGUAUGGGU-5'    (SEQ ID NO: 339)
AAT-1405 Target: 5'-GGGCCATGTTTTTAGAGGCCATACCCA-3' (SEQ ID NO: 537)

5'-CCAUGUUUUUAGAGGCCAUACCCAU-3'      (SEQ ID NO: 736)
              3'-CCGGUACAAAAAUCUCCGGUAUGGGUA-5'    (SEQ ID NO: 340)
AAT-1406 Target: 5'-GGCCATGTTTTTAGAGGCCATACCCAT-3' (SEQ ID NO: 538)

5'-CAUGUUUUUAGAGGCCAUACCCAUG-3'      (SEQ ID NO: 737)
              3'-CGGUACAAAAAUCUCCGGUAUGGGUAC-5'    (SEQ ID NO: 341)
AAT-1407 Target: 5'-GCCATGTTTTTAGAGGCCATACCCATG-3' (SEQ ID NO: 539)

5'-AUGUUUUUAGAGGCCAUACCCAUGU-3'      (SEQ ID NO: 738)
              3'-GGUACAAAAAUCUCCGGUAUGGGUACA-5'    (SEQ ID NO: 342)
AAT-1408 Target: 5'-CCATGTTTTTAGAGGCCATACCCATGT-3' (SEQ ID NO: 540)

5'-UGUUUUUAGAGGCCAUACCCAUGUC-3'      (SEQ ID NO: 739)
              3'-GUACAAAAAUCUCCGGUAUGGGUACAG-5'    (SEQ ID NO: 343)
AAT-1409 Target: 5'-CATGTTTTTAGAGGCCATACCCATGTC-3' (SEQ ID NO: 541)

5'-GUUUUUAGAGGCCAUACCCAUGUCU-3'      (SEQ ID NO: 740)
              3'-UACAAAAAUCUCCGGUAUGGGUACAGA-5'    (SEQ ID NO: 344)
AAT-1410 Target: 5'-ATGTTTTTAGAGGCCATACCCATGTCT-3' (SEQ ID NO: 542)

5'-UUUUUAGAGGCCAUACCCAUGUCUA-3'      (SEQ ID NO: 741)
              3'-ACAAAAAUCUCCGGUAUGGGUACAGAU-5'    (SEQ ID NO: 345)
AAT-1411 Target: 5'-TGTTTTTAGAGGCCATACCCATGTCTA-3' (SEQ ID NO: 543)

5'-UUUUAGAGGCCAUACCCAUGUCUAU-3'      (SEQ ID NO: 742)
              3'-CAAAAAUCUCCGGUAUGGGUACAGAUA-5'    (SEQ ID NO: 346)
AAT-1412 Target: 5'-GTTTTTAGAGGCCATACCCATGTCTAT-3' (SEQ ID NO: 544)

5'-UUUAGAGGCCAUACCCAUGUCUAUC-3'      (SEQ ID NO: 743)
              3'-AAAAAUCUCCGGUAUGGGUACAGAUAG-5'    (SEQ ID NO: 347)
AAT-1413 Target: 5'-TTTTTAGAGGCCATACCCATGTCTATC-3' (SEQ ID NO: 545)

5'-UUAGAGGCCAUACCCAUGUCUAUCC-3'      (SEQ ID NO: 744)
              3'-AAAAUCUCCGGUAUGGGUACAGAUAGG-5'    (SEQ ID NO: 348)
AAT-1414 Target: 5'-TTTTAGAGGCCATACCCATGTCTATCC-3' (SEQ ID NO: 546)

5'-UAGAGGCCAUACCCAUGUCUAUCCC-3'      (SEQ ID NO: 745)
              3'-AAAUCUCCGGUAUGGGUACAGAUAGGG-5'    (SEQ ID NO: 349)
AAT-1415 Target: 5'-TTTAGAGGCCATACCCATGTCTATCCC-3' (SEQ ID NO: 547)

5'-AGAGGCCAUACCCAUGUCUAUCCCC-3'      (SEQ ID NO: 746)
              3'-AAUCUCCGGUAUGGGUACAGAUAGGGG-5'    (SEQ ID NO: 350)
AAT-1416 Target: 5'-TTAGAGGCCATACCCATGTCTATCCCC-3' (SEQ ID NO: 548)

5'-GUUCAACAAACCCUUUGUCUUCUUA-3'      (SEQ ID NO: 747)
              3'-UUCAAGUUGUUUGGGAAACAGAAGAAU-5'    (SEQ ID NO: 351)
AAT-1452 Target: 5'-AAGTTCAACAAACCCTTTGTCTTCTTA-3' (SEQ ID NO: 549)

5'-UUCAACAAACCCUUUGUCUUCUUAA-3'      (SEQ ID NO: 748)
              3'-UCAAGUUGUUUGGGAAACAGAAGAAUU-5'    (SEQ ID NO: 352)
AAT-1453 Target: 5'-AGTTCAACAAACCCTTTGTCTTCTTAA-3' (SEQ ID NO: 550)

5'-UCAACAAACCCUUUGUCUUCUUAAU-3'      (SEQ ID NO: 749)
              3'-CAAGUUGUUUGGGAAACAGAAGAAUUA-5'    (SEQ ID NO: 353)
AAT-1454 Target: 5'-GTTCAACAAACCCTTTGTCTTCTTAAT-3' (SEQ ID NO: 551)

5'-CAACAAACCCUUUGUCUUCUUAAUG-3'      (SEQ ID NO: 750)
              3'-AAGUUGUUUGGGAAACAGAAGAAUUAC-5'    (SEQ ID NO: 354)
AAT-1455 Target: 5'-TTCAACAAACCCTTTGTCTTCTTAATG-3' (SEQ ID NO: 552)
```

TABLE 3-continued

Selected Human Anti-α-1 antitrypsin DsiRNAs, Unmodified Duplexes
(Asymmetrics)

```
                5'-AACAAACCCUUUGUCUUCUUAAUGA-3'     (SEQ ID NO: 751)
                3'-AGUUGUUUGGGAAACAGAAGAAUUACU-5'   (SEQ ID NO: 355)
AAT-1456 Target: 5'-TCAACAAACCCTTTGTCTTCTTAATGA-3'  (SEQ ID NO: 553)

5'-ACAAACCCUUUGUCUUCUUAAUGAU-3'     (SEQ ID NO: 752)
                3'-GUUGUUUGGGAAACAGAAGAAUUACUA-5'   (SEQ ID NO: 356)
AAT-1457 Target: 5'-CAACAAACCCTTTGTCTTCTTAATGAT-3'  (SEQ ID NO: 554)

5'-CAAACCCUUUGUCUUCUUAAUGAUU-3'     (SEQ ID NO: 753)
                3'-UUGUUUGGGAAACAGAAGAAUUACUAA-5'   (SEQ ID NO: 357)
AAT-1458 Target: 5'-AACAAACCCTTTGTCTTCTTAATGATT-3'  (SEQ ID NO: 555)

5'-AAACCCUUUGUCUUCUUAAUGAUUG-3'     (SEQ ID NO: 754)
                3'-UGUUUGGGAAACAGAAGAAUUACUAAC-5'   (SEQ ID NO: 358)
AAT-1459 Target: 5'-ACAAACCCTTTGTCTTCTTAATGATTG-3'  (SEQ ID NO: 556)

5'-AACCCUUUGUCUUCUUAAUGAUUGA-3'     (SEQ ID NO: 755)
                3'-GUUUGGGAAACAGAAGAAUUACUAACU-5'   (SEQ ID NO: 359)
AAT-1460 Target: 5'-CAAACCCTTTGTCTTCTTAATGATTGA-3'  (SEQ ID NO: 557)

5'-AAUACCAAGUCUCCCCUCUUCAUGG-3'     (SEQ ID NO: 756)
                3'-UUUUAUGGUUCAGAGGGGAGAAGUACC-5'   (SEQ ID NO: 360)
AAT-1489 Target: 5'-AAAATACCAAGTCTCCCCTCTTCATGG-3'  (SEQ ID NO: 558)

5'-AUACCAAGUCUCCCCUCUUCAUGGG-3'     (SEQ ID NO: 757)
                3'-UUUAUGGUUCAGAGGGGAGAAGUACCC-5'   (SEQ ID NO: 361)
AAT-1490 Target: 5'-AAATACCAAGTCTCCCCTCTTCATGGG-3'  (SEQ ID NO: 559)

5'-UACCAAGUCUCCCCUCUUCAUGGGA-3'     (SEQ ID NO: 758)
                3'-UUAUGGUUCAGAGGGGAGAAGUACCCU-5'   (SEQ ID NO: 362)
AAT-1491 Target: 5'-AATACCAAGTCTCCCCTCTTCATGGGA-3'  (SEQ ID NO: 560)

5'-ACCAAGUCUCCCCUCUUCAUGGGAA-3'     (SEQ ID NO: 759)
                3'-UAUGGUUCAGAGGGGAGAAGUACCCUU-5'   (SEQ ID NO: 363)
AAT-1492 Target: 5'-ATACCAAGTCTCCCCTCTTCATGGGAA-3'  (SEQ ID NO: 561)

5'-CCAAGUCUCCCCUCUUCAUGGGAAA-3'     (SEQ ID NO: 760)
                3'-AUGGUUCAGAGGGGAGAAGUACCCUUU-5'   (SEQ ID NO: 364)
AAT-1493 Target: 5'-TACCAAGTCTCCCCTCTTCATGGGAAA-3'  (SEQ ID NO: 562)

5'-CAAGUCUCCCCUCUUCAUGGGAAAA-3'     (SEQ ID NO: 761)
                3'-UGGUUCAGAGGGGAGAAGUACCCUUUU-5'   (SEQ ID NO: 365)
AAT-1494 Target: 5'-ACCAAGTCTCCCCTCTTCATGGGAAAA-3'  (SEQ ID NO: 563)

5'-AAGUCUCCCCUCUUCAUGGGAAAAG-3'     (SEQ ID NO: 762)
                3'-GGUUCAGAGGGGAGAAGUACCCUUUUC-5'   (SEQ ID NO: 366)
AAT-1495 Target: 5'-CCAAGTCTCCCCTCTTCATGGGAAAAG-3'  (SEQ ID NO: 564)

5'-AGUCUCCCCUCUUCAUGGGAAAAGU-3'     (SEQ ID NO: 763)
                3'-GUUCAGAGGGGAGAAGUACCCUUUUCA-5'   (SEQ ID NO: 367)
AAT-1496 Target: 5'-CAAGTCTCCCCTCTTCATGGGAAAAGT-3'  (SEQ ID NO: 565)

5'-GUCUCCCCUCUUCAUGGGAAAAGUG-3'     (SEQ ID NO: 764)
                3'-UUCAGAGGGGAGAAGUACCCUUUUCAC-5'   (SEQ ID NO: 368)
AAT-1497 Target: 5'-AAGTCTCCCCTCTTCATGGGAAAAGTG-3'  (SEQ ID NO: 566)

5'-CUCCCCUCUUCAUGGGAAAAGUGGU-3'     (SEQ ID NO: 765)
                3'-CAGAGGGGAGAAGUACCCUUUUCACCA-5'   (SEQ ID NO: 369)
AAT-1499 Target: 5'-GTCTCCCCTCTTCATGGGAAAAGTGGT-3'  (SEQ ID NO: 567)

5'-CCCCUCUUCAUGGGAAAAGUGGUGA-3'     (SEQ ID NO: 766)
                3'-GAGGGGAGAAGUACCCUUUUCACCACU-5'   (SEQ ID NO: 370)
AAT-1501 Target: 5'-CTCCCCTCTTCATGGGAAAAGTGGTGA-3'  (SEQ ID NO: 568)

5'-CCCUCUUCAUGGGAAAAGUGGUGAA-3'     (SEQ ID NO: 767)
                3'-AGGGGAGAAGUACCCUUUUCACCACUU-5'   (SEQ ID NO: 371)
AAT-1502 Target: 5'-TCCCCTCTTCATGGGAAAAGTGGTGAA-3'  (SEQ ID NO: 569)

5'-CCUCUUCAUGGGAAAAGUGGUGAAU-3'     (SEQ ID NO: 768)
                3'-GGGGAGAAGUACCCUUUUCACCACUUA-5'   (SEQ ID NO: 372)
AAT-1503 Target: 5'-CCCCTCTTCATGGGAAAAGTGGTGAAT-3' (SEQ ID NO: 570)

5'-CUCUUCAUGGGAAAAGUGGUGAAUC-3'     (SEQ ID NO: 769)
                3'-GGGAGAAGUACCCUUUUCACCACUUAG-5'   (SEQ ID NO: 373)
AAT-1504 Target: 5'-CCCTCTTCATGGGAAAAGTGGTGAATC-3' (SEQ ID NO: 571)
```

TABLE 3-continued

Selected Human Anti-α-1 antitrypsin DsiRNAs, Unmodified Duplexes
(Asymmetrics)

|  |  |  |
|---|---|---|
|  | 5'-UCUUCAUGGGAAAAGUGGUGAAUCC-3' | (SEQ ID NO: 770) |
|  | 3'-GGAGAAGUACCCUUUUCACCACUUAGG-5' | (SEQ ID NO: 374) |
| AAT-1505 Target: | 5'-CCTCTTCATGGGAAAAGTGGTGAATCC-3' | (SEQ ID NO: 572) |
|  | 5'-CUUCAUGGGAAAAGUGGUGAAUCCC-3' | (SEQ ID NO: 771) |
|  | 3'-GAGAAGUACCCUUUUCACCACUUAGGG-5' | (SEQ ID NO: 375) |
| AAT-1506 Target: | 5'-CTCTTCATGGGAAAAGTGGTGAATCCC-3' | (SEQ ID NO: 573) |
|  | 5'-UUCAUGGGAAAAGUGGUGAAUCCCA-3' | (SEQ ID NO: 772) |
|  | 3'-AGAAGUACCCUUUUCACCACUUAGGGU-5' | (SEQ ID NO: 376) |
| AAT-1507 Target: | 5'-TCTTCATGGGAAAAGTGGTGAATCCCA-3' | (SEQ ID NO: 574) |
|  | 5'-UCAUGGGAAAAGUGGUGAAUCCCAC-3' | (SEQ ID NO: 773) |
|  | 3'-GAAGUACCCUUUUCACCACUUAGGGUG-5' | (SEQ ID NO: 377) |
| AAT-1508 Target: | 5'-CTTCATGGGAAAAGTGGTGAATCCCAC-3' | (SEQ ID NO: 575) |
|  | 5'-CAUGGGAAAAGUGGUGAAUCCCACC-3' | (SEQ ID NO: 774) |
|  | 3'-AAGUACCCUUUUCACCACUUAGGGUGG-5' | (SEQ ID NO: 378) |
| AAT-1509 Target: | 5'-TTCATGGGAAAAGTGGTGAATCCCACC-3' | (SEQ ID NO: 576) |
|  | 5'-AUGGGAAAAGUGGUGAAUCCCACCC-3' | (SEQ ID NO: 775) |
|  | 3'-AGUACCCUUUUCACCACUUAGGGUGGG-5' | (SEQ ID NO: 379) |
| AAT-1510 Target: | 5'-TCATGGGAAAAGTGGTGAATCCCACCC-3' | (SEQ ID NO: 577) |
|  | 5'-UGGGAAAAGUGGUGAAUCCCACCCA-3' | (SEQ ID NO: 776) |
|  | 3'-GUACCCUUUUCACCACUUAGGGUGGGU-5' | (SEQ ID NO: 380) |
| AAT-1511 Target: | 5'-CATGGGAAAAGTGGTGAATCCCACCCA-3' | (SEQ ID NO: 578) |
|  | 5'-GGGAAAAGUGGUGAAUCCCACCCAA-3' | (SEQ ID NO: 777) |
|  | 3'-UACCCUUUUCACCACUUAGGGUGGGUU-5' | (SEQ ID NO: 381) |
| AAT-1512 Target: | 5'-ATGGGAAAAGTGGTGAATCCCACCCAA-3' | (SEQ ID NO: 579) |
|  | 5'-GGAAAAGUGGUGAAUCCCACCCAAA-3' | (SEQ ID NO: 778) |
|  | 3'-ACCCUUUUCACCACUUAGGGUGGGUUU-5' | (SEQ ID NO: 382) |
| AAT-1513 Target: | 5'-TGGGAAAAGTGGTGAATCCCACCCAAA-3' | (SEQ ID NO: 580) |
|  | 5'-GAAAAGUGGUGAAUCCCACCCAAAA-3' | (SEQ ID NO: 779) |
|  | 3'-CCCUUUUCACCACUUAGGGUGGGUUUU-5' | (SEQ ID NO: 383) |
| AAT-1514 Target: | 5'-GGGAAAAGTGGTGAATCCCACCCAAAA-3' | (SEQ ID NO: 581) |
|  | 5'-AAAAGUGGUGAAUCCCACCCAAAAA-3' | (SEQ ID NO: 780) |
|  | 3'-CCUUUUCACCACUUAGGGUGGGUUUUU-5' | (SEQ ID NO: 384) |
| AAT-1515 Target: | 5'-GGAAAAGTGGTGAATCCCACCCAAAAA-3' | (SEQ ID NO: 582) |
|  | 5'-AAAGUGGUGAAUCCCACCCAAAAAU-3' | (SEQ ID NO: 781) |
|  | 3'-CUUUUCACCACUUAGGGUGGGUUUUUA-5' | (SEQ ID NO: 385) |
| AAT-1516 Target: | 5'-GAAAAGTGGTGAATCCCACCCAAAAAT-3' | (SEQ ID NO: 583) |
|  | 5'-AAGUGGUGAAUCCCACCCAAAAAUA-3' | (SEQ ID NO: 782) |
|  | 3'-UUUUCACCACUUAGGGUGGGUUUUUAU-5' | (SEQ ID NO: 386) |
| AAT-1517 Target: | 5'-AAAAGTGGTGAATCCCACCCAAAAATA-3' | (SEQ ID NO: 584) |
|  | 5'-CGAUAGUUCAAAAUGGUGAAAUUAG-3' | (SEQ ID NO: 783) |
|  | 3'-AAGCUAUCAAGUUUUACCACUUUAAUC-5' | (SEQ ID NO: 387) |
| AAT-2872 Target: | 5'-TTCGATAGTTCAAAATGGTGAAATTAG-3' | (SEQ ID NO: 585) |
|  | 5'-CAAAAUGGUGAAAUUAGCAAUUCUA-3' | (SEQ ID NO: 784) |
|  | 3'-AAGUUUUACCACUUUAAUCGUUAAGAU-5' | (SEQ ID NO: 388) |
| AAT-2880 Target: | 5'-TTCAAAATGGTGAAATTAGCAATTCTA-3' | (SEQ ID NO: 586) |
|  | 5'-UUGGUAUGAUGUUCAAGUUAGAUAA-3' | (SEQ ID NO: 785) |
|  | 3'-UCAACCAUACUACAAGUUCAAUCUAUU-5' | (SEQ ID NO: 389) |
| AAT-3167 Target: | 5'-AGTTGGTATGATGTTCAAGTTAGATAA-3' | (SEQ ID NO: 587) |
|  | 5'-GGUAUGAUGUUCAAGUUAGAUAACA-3' | (SEQ ID NO: 786) |
|  | 3'-AACCAUACUACAAGUUCAAUCUAUUGU-5' | (SEQ ID NO: 390) |
| AAT-3169 Target: | 5'-TTGGTATGATGTTCAAGTTAGATAACA-3' | (SEQ ID NO: 588) |
|  | 5'-GUAUGAUGUUCAAGUUAGAUAACAA-3' | (SEQ ID NO: 787) |
|  | 3'-ACCAUACUACAAGUUCAAUCUAUUGUU-5' | (SEQ ID NO: 391) |
| AAT-3170 Target: | 5'-TGGTATGATGTTCAAGTTAGATAACAA-3' | (SEQ ID NO: 589) |
|  | 5'-AUGAUGUUCAAGUUAGAUAACAAAA-3' | (SEQ ID NO: 788) |
|  | 3'-CAUACUACAAGUUCAAUCUAUUGUUUU-5' | (SEQ ID NO: 392) |
| AAT-3172 Target: | 5'-GTATGATGTTCAAGTTAGATAACAAAA-3' | (SEQ ID NO: 590) |

TABLE 3-continued

Selected Human Anti-α-1 antitrypsin DsiRNAs, Unmodified Duplexes
(Asymmetrics)

```
               5'-AUGUUCAAGUUAGAUAACAAAAUGU-3'     (SEQ ID NO: 789)
               3'-ACUACAAGUUCAAUCUAUUGUUUUACA-5'   (SEQ ID NO: 393)
AAT-3175 Target: 5'-TGATGTTCAAGTTAGATAACAAATGT-3'  (SEQ ID NO: 591)

5'-CAAGUUAGAUAACAAAAUGUUUAUA-3'     (SEQ ID NO: 790)
               3'-AAGUUCAAUCUAUUGUUUUACAAAUAU-5'   (SEQ ID NO: 394)
AAT-3180 Target: 5'-TTCAAGTTAGATAACAAATGTTTATA-3'  (SEQ ID NO: 592)

5'-AAGUUAGAUAACAAAAUGUUUAUAC-3'     (SEQ ID NO: 791)
               3'-AGUUCAAUCUAUUGUUUUACAAAUAUG-5'   (SEQ ID NO: 395)
AAT-3181 Target: 5'-TCAAGTTAGATAACAAATGTTTATAC-3'  (SEQ ID NO: 593)

5'-AGUUAGAUAACAAAAUGUUUAUACC-3'    (SEQ ID NO: 792)
               3'-GUUCAAUCUAUUGUUUUACAAAUAUGG-5'  (SEQ ID NO: 396)
AAT-3182 Target: 5'-CAAGTTAGATAACAAATGTTTATACC-3' (SEQ ID NO: 594)
```

TABLE 4

DsiRNA Target Sequences (21mers) in α-1 antitrypsin mRNA

```
AAT-395 21 nt Target:   5'-UACAUCCCACCAUGAUCAGGA-3'   (SEQ ID NO: 793)
AAT-475 21 nt Target:   5'-GCCAGCUGGCACACCAGUCCA-3'   (SEQ ID NO: 794)
AAT-477 21 nt Target:   5'-CAGCUGGCACACCAGUCCAAC-3'   (SEQ ID NO: 795)
AAT-480 21 nt Target:   5'-CUGGCACACCAGUCCAACAGC-3'   (SEQ ID NO: 796)
AAT-481 21 nt Target:   5'-UGGCACACCAGUCCAACAGCA-3'   (SEQ ID NO: 797)
AAT-482 21 nt Target:   5'-GGCACACCAGUCCAACAGCAC-3'   (SEQ ID NO: 798)
AAT-483 21 nt Target:   5'-GCACACCAGUCCAACAGCACC-3'   (SEQ ID NO: 799)
AAT-484 21 nt Target:   5'-CACACCAGUCCAACAGCACCA-3'   (SEQ ID NO: 800)
AAT-500 21 nt Target:   5'-CACCAAUAUCUUCUUCUCCCC-3'   (SEQ ID NO: 801)
AAT-501 21 nt Target:   5'-ACCAAUAUCUUCUUCUCCCCA-3'   (SEQ ID NO: 802)
AAT-502 21 nt Target:   5'-CCAAUAUCUUCUUCUCCCCAG-3'   (SEQ ID NO: 803)
AAT-503 21 nt Target:   5'-CAAUAUCUUCUUCUCCCCAGU-3'   (SEQ ID NO: 804)
AAT-504 21 nt Target:   5'-AAUAUCUUCUUCUCCCCAGUG-3'   (SEQ ID NO: 805)
AAT-505 21 nt Target:   5'-AUAUCUUCUUCUCCCCAGUGA-3'   (SEQ ID NO: 806)
AAT-506 21 nt Target:   5'-UAUCUUCUUCUCCCCAGUGAG-3'   (SEQ ID NO: 807)
AAT-507 21 nt Target:   5'-AUCUUCUUCUCCCCAGUGAGC-3'   (SEQ ID NO: 808)
AAT-508 21 nt Target:   5'-UCUUCUUCUCCCCAGUGAGCA-3'   (SEQ ID NO: 809)
AAT-509 21 nt Target:   5'-CUUCUUCUCCCCAGUGAGCAU-3'   (SEQ ID NO: 810)
AAT-510 21 nt Target:   5'-UUCUUCUCCCCAGUGAGCAUC-3'   (SEQ ID NO: 811)
AAT-512 21 nt Target:   5'-CUUCUCCCCAGUGAGCAUCGC-3'   (SEQ ID NO: 812)
AAT-513 21 nt Target:   5'-UUCUCCCCAGUGAGCAUCGCU-3'   (SEQ ID NO: 813)
AAT-515 21 nt Target:   5'-CUCCCCAGUGAGCAUCGCUAC-3'   (SEQ ID NO: 814)
AAT-532 21 nt Target:   5'-CUACAGCCUUUGCAAUGCUCU-3'   (SEQ ID NO: 815)
AAT-540 21 nt Target:   5'-UUUGCAAUGCUCUCCCUGGGG-3'   (SEQ ID NO: 816)
AAT-581 21 nt Target:   5'-UGAAAUCCUGGAGGGCCUGAA-3'   (SEQ ID NO: 817)
AAT-582 21 nt Target:   5'-GAAAUCCUGGAGGGCCUGAAU-3'   (SEQ ID NO: 818)
AAT-583 21 nt Target:   5'-AAAUCCUGGAGGGCCUGAAUU-3'   (SEQ ID NO: 819)
```

TABLE 4-continued

DsiRNA Target Sequences (21mers) in α-1 antitrypsin mRNA

| | | | |
|---|---|---|---|
| AAT-585 21 nt Target: | 5'-AUCCUGGAGGGCCUGAAUUUC-3' | (SEQ ID NO: 820) |
| AAT-586 21 nt Target: | 5'-UCCUGGAGGGCCUGAAUUUCA-3' | (SEQ ID NO: 821) |
| AAT-587 21 nt Target: | 5'-CCUGGAGGGCCUGAAUUUCAA-3' | (SEQ ID NO: 822) |
| AAT-634 21 nt Target: | 5'-UCCAUGAAGGCUUCCAGGAAC-3' | (SEQ ID NO: 823) |
| AAT-637 21 nt Target: | 5'-AUGAAGGCUUCCAGGAACUCC-3' | (SEQ ID NO: 824) |
| AAT-638 21 nt Target: | 5'-UGAAGGCUUCCAGGAACUCCU-3' | (SEQ ID NO: 825) |
| AAT-671 21 nt Target: | 5'-CCAGCCAGACAGCCAGCUCCA-3' | (SEQ ID NO: 826) |
| AAT-673 21 nt Target: | 5'-AGCCAGACAGCCAGCUCCAGC-3' | (SEQ ID NO: 827) |
| AAT-675 21 nt Target: | 5'-CCAGACAGCCAGCUCCAGCUG-3' | (SEQ ID NO: 828) |
| AAT-676 21 nt Target: | 5'-CAGACAGCCAGCUCCAGCUGA-3' | (SEQ ID NO: 829) |
| AAT-734 21 nt Target: | 5'-GCUAGUGGAUAAGUUUUUGGA-3' | (SEQ ID NO: 830) |
| AAT-735 21 nt Target: | 5'-CUAGUGGAUAAGUUUUUGGAG-3' | (SEQ ID NO: 831) |
| AAT-736 21 nt Target: | 5'-UAGUGGAUAAGUUUUUGGAGG-3' | (SEQ ID NO: 832) |
| AAT-737 21 nt Target: | 5'-AGUGGAUAAGUUUUUGGAGGA-3' | (SEQ ID NO: 833) |
| AAT-738 21 nt Target: | 5'-GUGGAUAAGUUUUUGGAGGAU-3' | (SEQ ID NO: 834) |
| AAT-739 21 nt Target: | 5'-UGGAUAAGUUUUUGGAGGAUG-3' | (SEQ ID NO: 835) |
| AAT-740 21 nt Target: | 5'-GGAUAAGUUUUUGGAGGAUGU-3' | (SEQ ID NO: 836) |
| AAT-767 21 nt Target: | 5'-GUUGUACCACUCAGAAGCCUU-3' | (SEQ ID NO: 837) |
| AAT-768 21 nt Target: | 5'-UUGUACCACUCAGAAGCCUUC-3' | (SEQ ID NO: 838) |
| AAT-850 21 nt Target: | 5'-GUACUCAAGGGAAAAUUGUGG-3' | (SEQ ID NO: 839) |
| AAT-851 21 nt Target: | 5'-UACUCAAGGGAAAAUUGUGGA-3' | (SEQ ID NO: 840) |
| AAT-852 21 nt Target: | 5'-ACUCAAGGGAAAAUUGUGGAU-3' | (SEQ ID NO: 841) |
| AAT-853 21 nt Target: | 5'-CUCAAGGGAAAAUUGUGGAUU-3' | (SEQ ID NO: 842) |
| AAT-854 21 nt Target: | 5'-UCAAGGGAAAAUUGUGGAUUU-3' | (SEQ ID NO: 843) |
| AAT-855 21 nt Target: | 5'-CAAGGGAAAAUUGUGGAUUUG-3' | (SEQ ID NO: 844) |
| AAT-856 21 nt Target: | 5'-AAGGGAAAAUUGUGGAUUUGG-3' | (SEQ ID NO: 845) |
| AAT-857 21 nt Target: | 5'-AGGGAAAAUUGUGGAUUUGGU-3' | (SEQ ID NO: 846) |
| AAT-858 21 nt Target: | 5'-GGGAAAAUUGUGGAUUUGGUC-3' | (SEQ ID NO: 847) |
| AAT-859 21 nt Target: | 5'-GGAAAAUUGUGGAUUUGGUCA-3' | (SEQ ID NO: 848) |
| AAT-860 21 nt Target: | 5'-GAAAAUUGUGGAUUUGGUCAA-3' | (SEQ ID NO: 849) |
| AAT-861 21 nt Target: | 5'-AAAAUUGUGGAUUUGGUCAAG-3' | (SEQ ID NO: 850) |
| AAT-862 21 nt Target: | 5'-AAAUUGUGGAUUUGGUCAAGG-3' | (SEQ ID NO: 851) |
| AAT-863 21 nt Target: | 5'-AAUUGUGGAUUUGGUCAAGGA-3' | (SEQ ID NO: 852) |
| AAT-864 21 nt Target: | 5'-AUUGUGGAUUUGGUCAAGGAG-3' | (SEQ ID NO: 853) |
| AAT-865 21 nt Target: | 5'-UUGUGGAUUUGGUCAAGGAGC-3' | (SEQ ID NO: 854) |
| AAT-866 21 nt Target: | 5'-UGUGGAUUUGGUCAAGGAGCU-3' | (SEQ ID NO: 855) |
| AAT-867 21 nt Target: | 5'-GUGGAUUUGGUCAAGGAGCUU-3' | (SEQ ID NO: 856) |
| AAT-868 21 nt Target: | 5'-UGGAUUUGGUCAAGGAGCUUG-3' | (SEQ ID NO: 857) |
| AAT-869 21 nt Target: | 5'-GGAUUUGGUCAAGGAGCUUGA-3' | (SEQ ID NO: 858) |

TABLE 4-continued

DsiRNA Target Sequences (21mers) in α-1 antitrypsin mRNA

| | | | |
|---|---|---|---|
| AAT-870 21 nt Target: | 5'-GAUUUGGUCAAGGAGCUUGAC-3' | (SEQ ID NO: 859) |
| AAT-871 21 nt Target: | 5'-AUUUGGUCAAGGAGCUUGACA-3' | (SEQ ID NO: 860) |
| AAT-872 21 nt Target: | 5'-UUUGGUCAAGGAGCUUGACAG-3' | (SEQ ID NO: 861) |
| AAT-896 21 nt Target: | 5'-CACAGUUUUUGCUCUGGUGAA-3' | (SEQ ID NO: 862) |
| AAT-897 21 nt Target: | 5'-ACAGUUUUUGCUCUGGUGAAU-3' | (SEQ ID NO: 863) |
| AAT-898 21 nt Target: | 5'-CAGUUUUUGCUCUGGUGAAUU-3' | (SEQ ID NO: 864) |
| AAT-899 21 nt Target: | 5'-AGUUUUUGCUCUGGUGAAUUA-3' | (SEQ ID NO: 865) |
| AAT-928 21 nt Target: | 5'-UUAAAGGCAAAUGGGAGAGAC-3' | (SEQ ID NO: 866) |
| AAT-929 21 nt Target: | 5'-UAAAGGCAAAUGGGAGAGACC-3' | (SEQ ID NO: 867) |
| AAT-930 21 nt Target: | 5'-AAAGGCAAAUGGGAGAGACCC-3' | (SEQ ID NO: 868) |
| AAT-931 21 nt Target: | 5'-AAGGCAAAUGGGAGAGACCCU-3' | (SEQ ID NO: 869) |
| AAT-968 21 nt Target: | 5'-CGAGGAAGAGGACUUCCACGU-3' | (SEQ ID NO: 870) |
| AAT-969 21 nt Target: | 5'-GAGGAAGAGGACUUCCACGUG-3' | (SEQ ID NO: 871) |
| AAT-970 21 nt Target: | 5'-AGGAAGAGGACUUCCACGUGG-3' | (SEQ ID NO: 872) |
| AAT-971 21 nt Target: | 5'-GGAAGAGGACUUCCACGUGGA-3' | (SEQ ID NO: 873) |
| AAT-973 21 nt Target: | 5'-AAGAGGACUUCCACGUGGACC-3' | (SEQ ID NO: 874) |
| AAT-974 21 nt Target: | 5'-AGAGGACUUCCACGUGGACCA-3' | (SEQ ID NO: 875) |
| AAT-976 21 nt Target: | 5'-AGGACUUCCACGUGGACCAGG-3' | (SEQ ID NO: 876) |
| AAT-1025 21 nt Target: | 5'-GCGUUUAGGCAUGUUUAACAU-3' | (SEQ ID NO: 877) |
| AAT-1026 21 nt Target: | 5'-CGUUUAGGCAUGUUUAACAUC-3' | (SEQ ID NO: 878) |
| AAT-1059 21 nt Target: | 5'-AAGCUGUCCAGCUGGGUGCUG-3' | (SEQ ID NO: 879) |
| AAT-1060 21 nt Target: | 5'-AGCUGUCCAGCUGGGUGCUGC-3' | (SEQ ID NO: 880) |
| AAT-1095 21 nt Target: | 5'-GGCAAUGCCACCGCCAUCUUC-3' | (SEQ ID NO: 881) |
| AAT-1096 21 nt Target: | 5'-GCAAUGCCACCGCCAUCUUCU-3' | (SEQ ID NO: 882) |
| AAT-1100 21 nt Target: | 5'-UGCCACCGCCAUCUUCUUCCU-3' | (SEQ ID NO: 883) |
| AAT-1101 21 nt Target: | 5'-GCCACCGCCAUCUUCUUCCUG-3' | (SEQ ID NO: 884) |
| AAT-1102 21 nt Target: | 5'-CCACCGCCAUCUUCUUCCUGC-3' | (SEQ ID NO: 885) |
| AAT-1103 21 nt Target: | 5'-CACCGCCAUCUUCUUCCUGCC-3' | (SEQ ID NO: 886) |
| AAT-1104 21 nt Target: | 5'-ACCGCCAUCUUCUUCCUGCCU-3' | (SEQ ID NO: 887) |
| AAT-1105 21 nt Target: | 5'-CCGCCAUCUUCUUCCUGCCUG-3' | (SEQ ID NO: 888) |
| AAT-1108 21 nt Target: | 5'-CCAUCUUCUUCCUGCCUGAUG-3' | (SEQ ID NO: 889) |
| AAT-1113 21 nt Target: | 5'-UUCUUCCUGCCUGAUGAGGGG-3' | (SEQ ID NO: 890) |
| AAT-1114 21 nt Target: | 5'-UCUUCCUGCCUGAUGAGGGGA-3' | (SEQ ID NO: 891) |
| AAT-1115 21 nt Target: | 5'-CUUCCUGCCUGAUGAGGGGAA-3' | (SEQ ID NO: 892) |
| AAT-1116 21 nt Target: | 5'-UUCCUGCCUGAUGAGGGGAAA-3' | (SEQ ID NO: 893) |
| AAT-1117 21 nt Target: | 5'-UCCUGCCUGAUGAGGGGAAAC-3' | (SEQ ID NO: 894) |
| AAT-1118 21 nt Target: | 5'-CCUGCCUGAUGAGGGGAAACU-3' | (SEQ ID NO: 895) |
| AAT-1139 21 nt Target: | 5'-ACAGCACCUGGAAAAUGAACU-3' | (SEQ ID NO: 896) |
| AAT-1140 21 nt Target: | 5'-CAGCACCUGGAAAAUGAACUC-3' | (SEQ ID NO: 897) |

TABLE 4-continued

DsiRNA Target Sequences (21mers) in α-1 antitrypsin mRNA

```
AAT-1141  21 nt Target:  5'-AGCACCUGGAAAAUGAACUCA-3'  (SEQ ID NO: 898)
AAT-1142  21 nt Target:  5'-GCACCUGGAAAAUGAACUCAC-3'  (SEQ ID NO: 899)
AAT-1143  21 nt Target:  5'-CACCUGGAAAAUGAACUCACC-3'  (SEQ ID NO: 900)
AAT-1166  21 nt Target:  5'-CGAUAUCAUCACCAAGUUCCU-3'  (SEQ ID NO: 901)
AAT-1167  21 nt Target:  5'-GAUAUCAUCACCAAGUUCCUG-3'  (SEQ ID NO: 902)
AAT-1168  21 nt Target:  5'-AUAUCAUCACCAAGUUCCUGG-3'  (SEQ ID NO: 903)
AAT-1169  21 nt Target:  5'-UAUCAUCACCAAGUUCCUGGA-3'  (SEQ ID NO: 904)
AAT-1170  21 nt Target:  5'-AUCAUCACCAAGUUCCUGGAA-3'  (SEQ ID NO: 905)
AAT-1171  21 nt Target:  5'-UCAUCACCAAGUUCCUGGAAA-3'  (SEQ ID NO: 906)
AAT-1172  21 nt Target:  5'-CAUCACCAAGUUCCUGGAAAA-3'  (SEQ ID NO: 907)
AAT-1173  21 nt Target:  5'-AUCACCAAGUUCCUGGAAAAU-3'  (SEQ ID NO: 908)
AAT-1174  21 nt Target:  5'-UCACCAAGUUCCUGGAAAAUG-3'  (SEQ ID NO: 909)
AAT-1175  21 nt Target:  5'-CACCAAGUUCCUGGAAAAUGA-3'  (SEQ ID NO: 910)
AAT-1286  21 nt Target:  5'-UAAGGUCUUCAGCAAUGGGGC-3'  (SEQ ID NO: 911)
AAT-1296  21 nt Target:  5'-AGCAAUGGGGCUGACCUCUCC-3'  (SEQ ID NO: 912)
AAT-1297  21 nt Target:  5'-GCAAUGGGGCUGACCUCUCCG-3'  (SEQ ID NO: 913)
AAT-1298  21 nt Target:  5'-CAAUGGGGCUGACCUCUCCGG-3'  (SEQ ID NO: 914)
AAT-1324  21 nt Target:  5'-CAGAGGAGGCACCCCUGAAGC-3'  (SEQ ID NO: 915)
AAT-1326  21 nt Target:  5'-GAGGAGGCACCCCUGAAGCUC-3'  (SEQ ID NO: 916)
AAT-1336  21 nt Target:  5'-CCCUGAAGCUCUCCAAGGCCG-3'  (SEQ ID NO: 917)
AAT-1353  21 nt Target:  5'-GCCGUGCAUAAGGCUGUGCUG-3'  (SEQ ID NO: 918)
AAT-1354  21 nt Target:  5'-CCGUGCAUAAGGCUGUGCUGA-3'  (SEQ ID NO: 919)
AAT-1355  21 nt Target:  5'-CGUGCAUAAGGCUGUGCUGAC-3'  (SEQ ID NO: 920)
AAT-1356  21 nt Target:  5'-GUGCAUAAGGCUGUGCUGACC-3'  (SEQ ID NO: 921)
AAT-1357  21 nt Target:  5'-UGCAUAAGGCUGUGCUGACCA-3'  (SEQ ID NO: 922)
AAT-1358  21 nt Target:  5'-GCAUAAGGCUGUGCUGACCAU-3'  (SEQ ID NO: 923)
AAT-1359  21 nt Target:  5'-CAUAAGGCUGUGCUGACCAUC-3'  (SEQ ID NO: 924)
AAT-1360  21 nt Target:  5'-AUAAGGCUGUGCUGACCAUCG-3'  (SEQ ID NO: 925)
AAT-1361  21 nt Target:  5'-UAAGGCUGUGCUGACCAUCGA-3'  (SEQ ID NO: 926)
AAT-1390  21 nt Target:  5'-GGACUGAAGCUGCUGGGGCCA-3'  (SEQ ID NO: 927)
AAT-1391  21 nt Target:  5'-GACUGAAGCUGCUGGGGCCAU-3'  (SEQ ID NO: 928)
AAT-1392  21 nt Target:  5'-ACUGAAGCUGCUGGGGCCAUG-3'  (SEQ ID NO: 929)
AAT-1393  21 nt Target:  5'-CUGAAGCUGCUGGGGCCAUGU-3'  (SEQ ID NO: 930)
AAT-1394  21 nt Target:  5'-UGAAGCUGCUGGGGCCAUGUU-3'  (SEQ ID NO: 931)
AAT-1395  21 nt Target:  5'-GAAGCUGCUGGGGCCAUGUUU-3'  (SEQ ID NO: 932)
AAT-1405  21 nt Target:  5'-GGGCCAUGUUUUAGAGGCCA-3'   (SEQ ID NO: 933)
AAT-1406  21 nt Target:  5'-GGCCAUGUUUUAGAGGCCAU-3'   (SEQ ID NO: 934)
AAT-1407  21 nt Target:  5'-GCCAUGUUUUAGAGGCCAUA-3'   (SEQ ID NO: 935)
AAT-1408  21 nt Target:  5'-CCAUGUUUUAGAGGCCAUAC-3'   (SEQ ID NO: 936)
```

TABLE 4-continued

DsiRNA Target Sequences (21mers) in α-1 antitrypsin mRNA

AAT-1409 21 nt Target: 5'-CAUGUUUUUAGAGGCCAUACC-3' (SEQ ID NO: 937)

AAT-1410 21 nt Target: 5'-AUGUUUUUAGAGGCCAUACCC-3' (SEQ ID NO: 938)

AAT-1411 21 nt Target: 5'-UGUUUUUAGAGGCCAUACCCA-3' (SEQ ID NO: 939)

AAT-1412 21 nt Target: 5'-GUUUUUAGAGGCCAUACCCAU-3' (SEQ ID NO: 940)

AAT-1413 21 nt Target: 5'-UUUUUAGAGGCCAUACCCAUG-3' (SEQ ID NO: 941)

AAT-1414 21 nt Target: 5'-UUUUAGAGGCCAUACCCAUGU-3' (SEQ ID NO: 942)

AAT-1415 21 nt Target: 5'-UUUAGAGGCCAUACCCAUGUC-3' (SEQ ID NO: 943)

AAT-1416 21 nt Target: 5'-UUAGAGGCCAUACCCAUGUCU-3' (SEQ ID NO: 944)

AAT-1452 21 nt Target: 5'-AAGUUCAACAAACCCUUUGUC-3' (SEQ ID NO: 945)

AAT-1453 21 nt Target: 5'-AGUUCAACAAACCCUUUGUCU-3' (SEQ ID NO: 946)

AAT-1454 21 nt Target: 5'-GUUCAACAAACCCUUUGUCUU-3' (SEQ ID NO: 947)

AAT-1455 21 nt Target: 5'-UUCAACAAACCCUUUGUCUUC-3' (SEQ ID NO: 948)

AAT-1456 21 nt Target: 5'-UCAACAAACCCUUUGUCUUCU-3' (SEQ ID NO: 949)

AAT-1457 21 nt Target: 5'-CAACAAACCCUUUGUCUUCUU-3' (SEQ ID NO: 950)

AAT-1458 21 nt Target: 5'-AACAAACCCUUUGUCUUCUUA-3' (SEQ ID NO: 951)

AAT-1459 21 nt Target: 5'-ACAAACCCUUUGUCUUCUUAA-3' (SEQ ID NO: 952)

AAT-1460 21 nt Target: 5'-CAAACCCUUUGUCUUCUUAAU-3' (SEQ ID NO: 953)

AAT-1489 21 nt Target: 5'-AAAAUACCAAGUCUCCCCUCU-3' (SEQ ID NO: 954)

AAT-1490 21 nt Target: 5'-AAAUACCAAGUCUCCCCUCUU-3' (SEQ ID NO: 955)

AAT-1491 21 nt Target: 5'-AAUACCAAGUCUCCCCUCUUC-3' (SEQ ID NO: 956)

AAT-1492 21 nt Target: 5'-AUACCAAGUCUCCCCUCUUCA-3' (SEQ ID NO: 957)

AAT-1493 21 nt Target: 5'-UACCAAGUCUCCCCUCUUCAU-3' (SEQ ID NO: 958)

AAT-1494 21 nt Target: 5'-ACCAAGUCUCCCCUCUUCAUG-3' (SEQ ID NO: 959)

AAT-1495 21 nt Target: 5'-CCAAGUCUCCCCUCUUCAUGG-3' (SEQ ID NO: 960)

AAT-1496 21 nt Target: 5'-CAAGUCUCCCCUCUUCAUGGG-3' (SEQ ID NO: 961)

AAT-1497 21 nt Target: 5'-AAGUCUCCCCUCUUCAUGGGA-3' (SEQ ID NO: 962)

AAT-1499 21 nt Target: 5'-GUCUCCCCUCUUCAUGGGAAA-3' (SEQ ID NO: 963)

AAT-1501 21 nt Target: 5'-CUCCCCUCUUCAUGGGAAAAG-3' (SEQ ID NO: 964)

AAT-1502 21 nt Target: 5'-UCCCCUCUUCAUGGGAAAAGU-3' (SEQ ID NO: 965)

AAT-1503 21 nt Target: 5'-CCCCUCUUCAUGGGAAAAGUG-3' (SEQ ID NO: 966)

AAT-1504 21 nt Target: 5'-CCCUCUUCAUGGGAAAAGUGG-3' (SEQ ID NO: 967)

AAT-1505 21 nt Target: 5'-CCUCUUCAUGGGAAAAGUGGU-3' (SEQ ID NO: 968)

AAT-1506 21 nt Target: 5'-CUCUUCAUGGGAAAAGUGGUG-3' (SEQ ID NO: 969)

AAT-1507 21 nt Target: 5'-UCUUCAUGGGAAAAGUGGUGA-3' (SEQ ID NO: 970)

AAT-1508 21 nt Target: 5'-CUUCAUGGGAAAAGUGGUGAA-3' (SEQ ID NO: 971)

AAT-1509 21 nt Target: 5'-UUCAUGGGAAAAGUGGUGAAU-3' (SEQ ID NO: 972)

AAT-1510 21 nt Target: 5'-UCAUGGGAAAAGUGGUGAAUC-3' (SEQ ID NO: 973)

AAT-1511 21 nt Target: 5'-CAUGGGAAAAGUGGUGAAUCC-3' (SEQ ID NO: 974)

AAT-1512 21 nt Target: 5'-AUGGGAAAAGUGGUGAAUCCC-3' (SEQ ID NO: 975)

TABLE 4-continued

DsiRNA Target Sequences (21mers) in α-1 antitrypsin mRNA

AAT-1513 21 nt Target: 5'-UGGGAAAAGUGGUGAAUCCCA-3' (SEQ ID NO: 976)

AAT-1514 21 nt Target: 5'-GGGAAAAGUGGUGAAUCCCAC-3' (SEQ ID NO: 977)

AAT-1515 21 nt Target: 5'-GGAAAAGUGGUGAAUCCCACC-3' (SEQ ID NO: 978)

AAT-1516 21 nt Target: 5'-GAAAAGUGGUGAAUCCCACCC-3' (SEQ ID NO: 979)

AAT-1517 21 nt Target: 5'-AAAAGUGGUGAAUCCCACCCA-3' (SEQ ID NO: 980)

AAT-2872 21 nt Target: 5'-UUCGAUAGUUCAAAAUGGUGA-3' (SEQ ID NO: 981)

AAT-2880 21 nt Target: 5'-UUCAAAAUGGUGAAAUUAGCA-3' (SEQ ID NO: 982)

AAT-3167 21 nt Target: 5'-AGUUGGUAUGAUGUUCAAGUU-3' (SEQ ID NO: 983)

AAT-3169 21 nt Target: 5'-UUGGUAUGAUGUUCAAGUUAG-3' (SEQ ID NO: 984)

AAT-3170 21 nt Target: 5'-UGGUAUGAUGUUCAAGUUAGA-3' (SEQ ID NO: 985)

AAT-3172 21 nt Target: 5'-GUAUGAUGUUCAAGUUAGAUA-3' (SEQ ID NO: 986)

AAT-3175 21 nt Target: 5'-UGAUGUUCAAGUUAGAUAACA-3' (SEQ ID NO: 987)

AAT-3180 21 nt Target: 5'-UUCAAGUUAGAUAACAAAAUG-3' (SEQ ID NO: 988)

AAT-3181 21 nt Target: 5'-UCAAGUUAGAUAACAAAAUGU-3' (SEQ ID NO: 989)

AAT-3182 21 nt Target: 5'-CAAGUUAGAUAACAAAAUGUU-3' (SEQ ID NO: 990)

TABLE 5

Selected Human Anti-α-1 antitrypsin "Blunt/Blunt" DsiRNAs

```
              5'-UACAUCCCACCAUGAUCAGGAUCACCC-3'    (SEQ ID NO: 991)
              3'-AUGUAGGGUGGUACUAGUCCUAGUGGG-5'    (SEQ ID NO: 199)
AAT-395 Target: 5'-TACATCCCACCATGATCAGGATCACCC-3'  (SEQ ID NO: 397)

5'-GCCAGCUGGCACACCAGUCCAACAGCA-3'    (SEQ ID NO: 992)
              3'-CGGUCGACCGUGUGGUCAGGUUGUCGU-5'    (SEQ ID NO: 200)
AAT-475 Target: 5'-GCCAGCTGGCACACCAGTCCAACAGCA-3'  (SEQ ID NO: 398)

5'-CAGCUGGCACACCAGUCCAACAGCACC-3'    (SEQ ID NO: 993)
              3'-GUCGACCGUGUGGUCAGGUUGUCGUGG-5'    (SEQ ID NO: 201)
AAT-477 Target: 5'-CAGCTGGCACACCAGTCCAACAGCACC-3'  (SEQ ID NO: 399)

5'-CUGGCACACCAGUCCAACAGCACCAAU-3'    (SEQ ID NO: 994)
              3'-GACCGUGUGGUCAGGUUGUCGUGGUUA-5'    (SEQ ID NO: 202)
AAT-480 Target: 5'-CTGGCACACCAGTCCAACAGCACCAAT-3'  (SEQ ID NO: 400)

5'-UGGCACACCAGUCCAACAGCACCAAUA-3'    (SEQ ID NO: 995)
              3'-ACCGUGUGGUCAGGUUGUCGUGGUUAU-5'    (SEQ ID NO: 203)
AAT-481 Target: 5'-TGGCACACCAGTCCAACAGCACCAATA-3'  (SEQ ID NO: 401)

5'-GGCACACCAGUCCAACAGCACCAAUAU-3'    (SEQ ID NO: 996)
              3'-CCGUGUGGUCAGGUUGUCGUGGUUAUA-5'    (SEQ ID NO: 204)
AAT-482 Target: 5'-GGCACACCAGTCCAACAGCACCAATAT-3'  (SEQ ID NO: 402)

5'-GCACACCAGUCCAACAGCACCAAUAUC-3'    (SEQ ID NO: 997)
              3'-CGUGUGGUCAGGUUGUCGUGGUUAUAG-5'    (SEQ ID NO: 205)
AAT-483 Target: 5'-GCACACCAGTCCAACAGCACCAATATC-3'  (SEQ ID NO: 403)

5'-CACACCAGUCCAACAGCACCAAUAUCU-3'    (SEQ ID NO: 998)
              3'-GUGUGGUCAGGUUGUCGUGGUUAUAGA-5'    (SEQ ID NO: 206)
AAT-484 Target: 5'-CACACCAGTCCAACAGCACCAATATCT-3'  (SEQ ID NO: 404)

5'-CACCAAUAUCUUCUUCUCCCCAGUGAG-3'    (SEQ ID NO: 999)
              3'-GUGGUUAUAGAAGAAGAGGGGUCACUC-5'    (SEQ ID NO: 207)
AAT-500 Target: 5'-CACCAATATCTTCTTCTCCCCAGTGAG-3'  (SEQ ID NO: 405)

5'-ACCAAUAUCUUCUUCUCCCCAGUGAGC-3'    (SEQ ID NO: 1000)
              3'-UGGUUAUAGAAGAAGAGGGGUCACUCG-5'    (SEQ ID NO: 208)
AAT-501 Target: 5'-ACCAATATCTTCTTCTCCCCAGTGAGC-3'  (SEQ ID NO: 406)
```

TABLE 5-continued

Selected Human Anti-α-1 antitrypsin "Blunt/Blunt" DsiRNAs

```
                5'-CCAAUAUCUUCUUCUCCCCAGUGAGCA-3'    (SEQ ID NO: 1001)
                3'-GGUUAUAGAAGAAGAGGGGUCACUCGU-5'    (SEQ ID NO: 209)
AAT-502 Target: 5'-CCAATATCTTCTTCTCCCCAGTGAGCA-3'    (SEQ ID NO: 407)

5'-CAAUAUCUUCUUCUCCCCAGUGAGCAU-3'   (SEQ ID NO: 1002)
                3'-GUUAUAGAAGAAGAGGGGUCACUCGUA-5'   (SEQ ID NO: 210)
AAT-503 Target: 5'-CAATATCTTCTTCTCCCCAGTGAGCAT-3'   (SEQ ID NO: 408)

5'-AAUAUCUUCUUCUCCCCAGUGAGCAUC-3'   (SEQ ID NO: 1003)
                3'-UUAUAGAAGAAGAGGGGUCACUCGUAG-5'   (SEQ ID NO: 211)
AAT-504 Target: 5'-AATATCTTCTTCTCCCCAGTGAGCATC-3'   (SEQ ID NO: 409)

5'-AUAUCUUCUUCUCCCCAGUGAGCAUCG-3'   (SEQ ID NO: 1004)
                3'-UAUAGAAGAAGAGGGGUCACUCGUAGC-5'   (SEQ ID NO: 212)
AAT-505 Target: 5'-ATATCTTCTTCTCCCCAGTGAGCATCG-3'   (SEQ ID NO: 410)

5'-UAUCUUCUUCUCCCCAGUGAGCAUCGC-3'   (SEQ ID NO: 1005)
                3'-AUAGAAGAAGAGGGGUCACUCGUAGCG-5'   (SEQ ID NO: 213)
AAT-506 Target: 5'-TATCTTCTTCTCCCCAGTGAGCATCGC-3'   (SEQ ID NO: 411)

5'-AUCUUCUUCUCCCCAGUGAGCAUCGCU-3'   (SEQ ID NO: 1006)
                3'-UAGAAGAAGAGGGGUCACUCGUAGCGA-5'   (SEQ ID NO: 214)
AAT-507 Target: 5'-ATCTTCTTCTCCCCAGTGAGCATCGCT-3'   (SEQ ID NO: 412)

5'-UCUUCUUCUCCCCAGUGAGCAUCGCUA-3'   (SEQ ID NO: 1007)
                3'-AGAAGAAGAGGGGUCACUCGUAGCGAU-5'   (SEQ ID NO: 215)
AAT-508 Target: 5'-TCTTCTTCTCCCCAGTGAGCATCGCTA-3'   (SEQ ID NO: 413)

5'-CUUCUUCUCCCCAGUGAGCAUCGCUAC-3'   (SEQ ID NO: 1008)
                3'-GAAGAAGAGGGGUCACUCGUAGCGAUG-5'   (SEQ ID NO: 216)
AAT-509 Target: 5'-CTTCTTCTCCCCAGTGAGCATCGCTAC-3'   (SEQ ID NO: 414)

5'-UUCUUCUCCCCAGUGAGCAUCGCUACA-3'   (SEQ ID NO: 1009)
                3'-AAGAAGAGGGGUCACUCGUAGCGAUGU-5'   (SEQ ID NO: 217)
AAT-510 Target: 5'-TTCTTCTCCCCAGTGAGCATCGCTACA-3'   (SEQ ID NO: 415)

5'-CUUCUCCCCAGUGAGCAUCGCUACAGC-3'   (SEQ ID NO: 1010)
                3'-GAAGAGGGGUCACUCGUAGCGAUGUCG-5'   (SEQ ID NO: 218)
AAT-512 Target: 5'-CTTCTCCCCAGTGAGCATCGCTACAGC-3'   (SEQ ID NO: 416)

5'-UUCUCCCCAGUGAGCAUCGCUACAGCC-3'   (SEQ ID NO: 1011)
                3'-AAGAGGGGUCACUCGUAGCGAUGUCGG-5'   (SEQ ID NO: 219)
AAT-513 Target: 5'-TTCTCCCCAGTGAGCATCGCTACAGCC-3'   (SEQ ID NO: 417)

5'-CUCCCCAGUGAGCAUCGCUACAGCCUU-3'   (SEQ ID NO: 1012)
                3'-GAGGGGUCACUCGUAGCGAUGUCGGAA-5'   (SEQ ID NO: 220)
AAT-515 Target: 5'-CTCCCCAGTGAGCATCGCTACAGCCTT-3'   (SEQ ID NO: 418)

5'-CUACAGCCUUUGCAAUGCUCUCCCUGG-3'   (SEQ ID NO: 1013)
                3'-GAUGUCGGAAACGUUACGAGAGGGACC-5'   (SEQ ID NO: 221)
AAT-532 Target: 5'-CTACAGCCTTTGCAATGCTCTCCCTGG-3'   (SEQ ID NO: 419)

5'-UUUGCAAUGCUCUCCCUGGGGACCAAG-3'   (SEQ ID NO: 1014)
                3'-AAACGUUACGAGAGGGACCCCUGGUUC-5'   (SEQ ID NO: 222)
AAT-540 Target: 5'-TTTGCAATGCTCTCCCTGGGGACCAAG-3'   (SEQ ID NO: 420)

5'-UGAAAUCCUGGAGGGCCUGAAUUUCAA-3'   (SEQ ID NO: 1015)
                3'-ACUUUAGGACCUCCCGGACUUAAAGUU-5'   (SEQ ID NO: 223)
AAT-581 Target: 5'-TGAAATCCTGGAGGGCCTGAATTTCAA-3'   (SEQ ID NO: 421)

5'-GAAAUCCUGGAGGGCCUGAAUUUCAAC-3'   (SEQ ID NO: 1016)
                3'-CUUUAGGACCUCCCGGACUUAAAGUUG-5'   (SEQ ID NO: 224)
AAT-582 Target: 5'-GAAATCCTGGAGGGCCTGAATTTCAAC-3'   (SEQ ID NO: 422)

5'-AAAUCCUGGAGGGCCUGAAUUUCAACC-3'   (SEQ ID NO: 1017)
                3'-UUUAGGACCUCCCGGACUUAAAGUUGG-5'   (SEQ ID NO: 225)
AAT-583 Target: 5'-AAATCCTGGAGGGCCTGAATTTCAACC-3'   (SEQ ID NO: 423)

5'-AUCCUGGAGGGCCUGAAUUUCAACCUC-3'   (SEQ ID NO: 1018)
                3'-UAGGACCUCCCGGACUUAAAGUUGGAG-5'   (SEQ ID NO: 226)
AAT-585 Target: 5'-ATCCTGGAGGGCCTGAATTTCAACCTC-3'   (SEQ ID NO: 424)

5'-UCCUGGAGGGCCUGAAUUUCAACCUCA-3'   (SEQ ID NO: 1019)
                3'-AGGACCUCCCGGACUUAAAGUUGGAGU-5'   (SEQ ID NO: 227)
AAT-586 Target: 5'-TCCTGGAGGGCCTGAATTTCAACCTCA-3'   (SEQ ID NO: 425)
```

TABLE 5-continued

Selected Human Anti-α-1 antitrypsin "Blunt/Blunt" DsiRNAs

|  | | |
|---|---|---|
| | 5'-CCUGGAGGGCCUGAAUUUCAACCUCAC-3' | (SEQ ID NO: 1020) |
| | 3'-GGACCUCCCGGACUUAAAGUUGGAGUG-5' | (SEQ ID NO: 228) |
| AAT-587 Target: | 5'-CCTGGAGGGCCTGAATTTCAACCTCAC-3' | (SEQ ID NO: 426) |
| | 5'-UCCAUGAAGGCUUCCAGGAACUCCUCC-3' | (SEQ ID NO: 1021) |
| | 3'-AGGUACUUCCGAAGGUCCUUGAGGAGG-5' | (SEQ ID NO: 229) |
| AAT-634 Target: | 5'-TCCATGAAGGCTTCCAGGAACTCCTCC-3' | (SEQ ID NO: 427) |
| | 5'-AUGAAGGCUUCCAGGAACUCCUCCGUA-3' | (SEQ ID NO: 1022) |
| | 3'-UACUUCCGAAGGUCCUUGAGGAGGCAU-5' | (SEQ ID NO: 230) |
| AAT-637 Target: | 5'-ATGAAGGCTTCCAGGAACTCCTCCGTA-3' | (SEQ ID NO: 428) |
| | 5'-UGAAGGCUUCCAGGAACUCCUCCGUAC-3' | (SEQ ID NO: 1023) |
| | 3'-ACUUCCGAAGGUCCUUGAGGAGGCAUG-5' | (SEQ ID NO: 231) |
| AAT-638 Target: | 5'-TGAAGGCTTCCAGGAACTCCTCCGTAC-3' | (SEQ ID NO: 429) |
| | 5'-CCAGCCAGACAGCCAGCUCCAGCUGAC-3' | (SEQ ID NO: 1024) |
| | 3'-GGUCGGUCUGUCGGUCGAGGUCGACUG-5' | (SEQ ID NO: 232) |
| AAT-671 Target: | 5'-CCAGCCAGACAGCCAGCTCCAGCTGAC-3' | (SEQ ID NO: 430) |
| | 5'-AGCCAGACAGCCAGCUCCAGCUGACCA-3' | (SEQ ID NO: 1025) |
| | 3'-UCGGUCUGUCGGUCGAGGUCGACUGGU-5' | (SEQ ID NO: 233) |
| AAT-673 Target: | 5'-AGCCAGACAGCCAGCTCCAGCTGACCA-3' | (SEQ ID NO: 431) |
| | 5'-CCAGACAGCCAGCUCCAGCUGACCACC-3' | (SEQ ID NO: 1026) |
| | 3'-GGUCUGUCGGUCGAGGUCGACUGGUGG-5' | (SEQ ID NO: 234) |
| AAT-675 Target: | 5'-CCAGACAGCCAGCTCCAGCTGACCACC-3' | (SEQ ID NO: 432) |
| | 5'-CAGACAGCCAGCUCCAGCUGACCACCG-3' | (SEQ ID NO: 1027) |
| | 3'-GUCUGUCGGUCGAGGUCGACUGGUGGC-5' | (SEQ ID NO: 235) |
| AAT-676 Target: | 5'-CAGACAGCCAGCTCCAGCTGACCACCG-3' | (SEQ ID NO: 433) |
| | 5'-GCUAGUGGAUAAGUUUUUGGAGGAUGU-3' | (SEQ ID NO: 1028) |
| | 3'-CGAUCACCUAUUCAAAAACCUCCUACA-5' | (SEQ ID NO: 236) |
| AAT-734 Target: | 5'-GCTAGTGGATAAGTTTTTGGAGGATGT-3' | (SEQ ID NO: 434) |
| | 5'-CUAGUGGAUAAGUUUUUGGAGGAUGUU-3' | (SEQ ID NO: 1029) |
| | 3'-GAUCACCUAUUCAAAAACCUCCUACAA-5' | (SEQ ID NO: 237) |
| AAT-735 Target: | 5'-CTAGTGGATAAGTTTTTGGAGGATGTT-3' | (SEQ ID NO: 435) |
| | 5'-UAGUGGAUAAGUUUUUGGAGGAUGUUA-3' | (SEQ ID NO: 1030) |
| | 3'-AUCACCUAUUCAAAAACCUCCUACAAU-5' | (SEQ ID NO: 238) |
| AAT-736 Target: | 5'-TAGTGGATAAGTTTTTGGAGGATGTTA-3' | (SEQ ID NO: 436) |
| | 5'-AGUGGAUAAGUUUUUGGAGGAUGUUAA-3' | (SEQ ID NO: 1031) |
| | 3'-UCACCUAUUCAAAAACCUCCUACAAUU-5' | (SEQ ID NO: 239) |
| AAT-737 Target: | 5'-AGTGGATAAGTTTTTGGAGGATGTTAA-3' | (SEQ ID NO: 437) |
| | 5'-GUGGAUAAGUUUUUGGAGGAUGUUAAA-3' | (SEQ ID NO: 1032) |
| | 3'-CACCUAUUCAAAAACCUCCUACAAUUU-5' | (SEQ ID NO: 240) |
| AAT-738 Target: | 5'-GTGGATAAGTTTTTGGAGGATGTTAAA-3' | (SEQ ID NO: 438) |
| | 5'-UGGAUAAGUUUUUGGAGGAUGUUAAAA-3' | (SEQ ID NO: 1033) |
| | 3'-ACCUAUUCAAAAACCUCCUACAAUUUU-5' | (SEQ ID NO: 241) |
| AAT-739 Target: | 5'-TGGATAAGTTTTTGGAGGATGTTAAAA-3' | (SEQ ID NO: 439) |
| | 5'-GGAUAAGUUUUUGGAGGAUGUUAAAAA-3' | (SEQ ID NO: 1034) |
| | 3'-CCUAUUCAAAAACCUCCUACAAUUUUU-5' | (SEQ ID NO: 242) |
| AAT-740 Target: | 5'-GGATAAGTTTTTGGAGGATGTTAAAAA-3' | (SEQ ID NO: 440) |
| | 5'-GUUGUACCACUCAGAAGCCUUCACUGU-3' | (SEQ ID NO: 1035) |
| | 3'-CAACAUGGUGAGUCUUCGGAAGUGACA-5' | (SEQ ID NO: 243) |
| AAT-767 Target: | 5'-GTTGTACCACTCAGAAGCCTTCACTGT-3' | (SEQ ID NO: 441) |
| | 5'-UUGUACCACUCAGAAGCCUUCACUGUC-3' | (SEQ ID NO: 1036) |
| | 3'-AACAUGGUGAGUCUUCGGAAGUGACAG-5' | (SEQ ID NO: 244) |
| AAT-768 Target: | 5'-TTGTACCACTCAGAAGCCTTCACTGTC-3' | (SEQ ID NO: 442) |
| | 5'-GUACUCAAGGGAAAAUUGUGGAUUUGG-3' | (SEQ ID NO: 1037) |
| | 3'-CAUGAGUUCCCUUUUAACACCUAAACC-5' | (SEQ ID NO: 245) |
| AAT-850 Target: | 5'-GTACTCAAGGGAAAATTGTGGATTTGG-3' | (SEQ ID NO: 443) |
| | 5'-UACUCAAGGGAAAAUUGUGGAUUUGGU-3' | (SEQ ID NO: 1038) |
| | 3'-AUGAGUUCCCUUUUAACACCUAAACCA-5' | (SEQ ID NO: 246) |
| AAT-851 Target: | 5'-TACTCAAGGGAAAATTGTGGATTTGGT-3' | (SEQ ID NO: 444) |

TABLE 5-continued

Selected Human Anti-α-1 antitrypsin "Blunt/Blunt" DsiRNAs

```
                5'-ACUCAAGGGAAAAUUGUGGAUUUGGUC-3'  (SEQ ID NO: 1039)
                3'-UGAGUUCCCUUUUAACACCUAAACCAG-5'  (SEQ ID NO: 247)
AAT-852 Target: 5'-ACTCAAGGGAAAATTGTGGATTTGGTC-3'  (SEQ ID NO: 445)

5'-CUCAAGGGAAAAUUGUGGAUUUGGUCA-3'  (SEQ ID NO: 1040)
                3'-GAGUUCCCUUUUAACACCUAAACCAGU-5'  (SEQ ID NO: 248)
AAT-853 Target: 5'-CTCAAGGGAAAATTGTGGATTTGGTCA-3'  (SEQ ID NO: 446)

5'-UCAAGGGAAAAUUGUGGAUUUGGUCAA-3'  (SEQ ID NO: 1041)
                3'-AGUUCCCUUUUAACACCUAAACCAGUU-5'  (SEQ ID NO: 249)
AAT-854 Target: 5'-TCAAGGGAAAATTGTGGATTTGGTCAA-3'  (SEQ ID NO: 447)

5'-CAAGGGAAAAUUGUGGAUUUGGUCAAG-3'  (SEQ ID NO: 1042)
                3'-GUUCCCUUUUAACACCUAAACCAGUUC-5'  (SEQ ID NO: 250)
AAT-855 Target: 5'-CAAGGGAAAATTGTGGATTTGGTCAAG-3'  (SEQ ID NO: 448)

5'-AAGGGAAAAUUGUGGAUUUGGUCAAGG-3'  (SEQ ID NO: 1043)
                3'-UUCCCUUUUAACACCUAAACCAGUUCC-5'  (SEQ ID NO: 251)
AAT-856 Target: 5'-AAGGGAAAATTGTGGATTTGGTCAAGG-3'  (SEQ ID NO: 449)

5'-AGGGAAAAUUGUGGAUUUGGUCAAGGA-3'  (SEQ ID NO: 1044)
                3'-UCCCUUUUAACACCUAAACCAGUUCCU-5'  (SEQ ID NO: 252)
AAT-857 Target: 5'-AGGGAAAATTGTGGATTTGGTCAAGGA-3'  (SEQ ID NO: 450)

5'-GGGAAAAUUGUGGAUUUGGUCAAGGAG-3'  (SEQ ID NO: 1045)
                3'-CCCUUUUAACACCUAAACCAGUUCCUC-5'  (SEQ ID NO: 253)
AAT-858 Target: 5'-GGGAAAATTGTGGATTTGGTCAAGGAG-3'  (SEQ ID NO: 451)

5'-GGAAAAUUGUGGAUUUGGUCAAGGAGC-3'  (SEQ ID NO: 1046)
                3'-CCUUUUAACACCUAAACCAGUUCCUCG-5'  (SEQ ID NO: 254)
AAT-859 Target: 5'-GGAAAATTGTGGATTTGGTCAAGGAGC-3'  (SEQ ID NO: 452)

5'-GAAAAUUGUGGAUUUGGUCAAGGAGCU-3'  (SEQ ID NO: 1047)
                3'-CUUUUAACACCUAAACCAGUUCCUCGA-5'  (SEQ ID NO: 255)
AAT-860 Target: 5'-GAAAATTGTGGATTTGGTCAAGGAGCT-3'  (SEQ ID NO: 453)

5'-AAAAUUGUGGAUUUGGUCAAGGAGCUU-3'  (SEQ ID NO: 1048)
                3'-UUUUAACACCUAAACCAGUUCCUCGAA-5'  (SEQ ID NO: 256)
AAT-861 Target: 5'-AAAATTGTGGATTTGGTCAAGGAGCTT-3'  (SEQ ID NO: 454)

5'-AAAUUGUGGAUUUGGUCAAGGAGCUUG-3'  (SEQ ID NO: 1049)
                3'-UUUAACACCUAAACCAGUUCCUCGAAC-5'  (SEQ ID NO: 257)
AAT-862 Target: 5'-AAATTGTGGATTTGGTCAAGGAGCTTG-3'  (SEQ ID NO: 455)

5'-AAUUGUGGAUUUGGUCAAGGAGCUUGA-3'  (SEQ ID NO: 1050)
                3'-UUACACCUAAACCAGUUCCUCGAACU-5'   (SEQ ID NO: 258)
AAT-863 Target: 5'-AATTGTGGATTTGGTCAAGGAGCTTGA-3'  (SEQ ID NO: 456)

5'-AUUGUGGAUUUGGUCAAGGAGCUUGAC-3'  (SEQ ID NO: 1051)
                3'-UAACACCUAAACCAGUUCCUCGAACUG-5'  (SEQ ID NO: 259)
AAT-864 Target: 5'-ATTGTGGATTTGGTCAAGGAGCTTGAC-3'  (SEQ ID NO: 457)

5'-UUGUGGAUUUGGUCAAGGAGCUUGACA-3'  (SEQ ID NO: 1052)
                3'-AACACCUAAACCAGUUCCUCGAACUGU-5'  (SEQ ID NO: 260)
AAT-865 Target: 5'-TTGTGGATTTGGTCAAGGAGCTTGACA-3'  (SEQ ID NO: 458)

5'-UGUGGAUUUGGUCAAGGAGCUUGACAG-3'  (SEQ ID NO: 1053)
                3'-ACACCUAAACCAGUUCCUCGAACUGUC-5'  (SEQ ID NO: 261)
AAT-866 Target: 5'-TGTGGATTTGGTCAAGGAGCTTGACAG-3'  (SEQ ID NO: 459)

5'-GUGGAUUUGGUCAAGGAGCUUGACAGA-3'  (SEQ ID NO: 1054)
                3'-CACCUAAACCAGUUCCUCGAACUGUCU-5'  (SEQ ID NO: 262)
AAT-867 Target: 5'-GTGGATTTGGTCAAGGAGCTTGACAGA-3'  (SEQ ID NO: 460)

5'-UGGAUUUGGUCAAGGAGCUUGACAGAG-3'  (SEQ ID NO: 1055)
                3'-ACCUAAACCAGUUCCUCGAACUGUCUC-5'  (SEQ ID NO: 263)
AAT-868 Target: 5'-TGGATTTGGTCAAGGAGCTTGACAGAG-3'  (SEQ ID NO: 461)

5'-GGAUUUGGUCAAGGAGCUUGACAGAGA-3'  (SEQ ID NO: 1056)
                3'-CCUAAACCAGUUCCUCGAACUGUCUCU-5'  (SEQ ID NO: 264)
AAT-869 Target: 5'-GGATTTGGTCAAGGAGCTTGACAGAGA-3'  (SEQ ID NO: 462)

5'-GAUUUGGUCAAGGAGCUUGACAGAGAC-3'  (SEQ ID NO: 1057)
                3'-CUAAACCAGUUCCUCGAACUGUCUCUG-5'  (SEQ ID NO: 265)
AAT-870 Target: 5'-GATTTGGTCAAGGAGCTTGACAGAGAC-3'  (SEQ ID NO: 463)
```

TABLE 5-continued

Selected Human Anti-α-1 antitrypsin "Blunt/Blunt" DsiRNAs

```
               5'-AUUUGGUCAAGGAGCUUGACAGAGACA-3'   (SEQ ID NO: 1058)
               3'-UAAACCAGUUCCUCGAACUGUCUCUGU-5'   (SEQ ID NO: 266)
AAT-871 Target: 5'-ATTTGGTCAAGGAGCTTGACAGAGACA-3'  (SEQ ID NO: 464)

5'-UUUGGUCAAGGAGCUUGACAGAGACAC-3'   (SEQ ID NO: 1059)
               3'-AAACCAGUUCCUCGAACUGUCUCUGUG-5'   (SEQ ID NO: 267)
AAT-872 Target: 5'-TTTGGTCAAGGAGCTTGACAGAGACAC-3'  (SEQ ID NO: 465)

5'-CACAGUUUUUGCUCUGGUGAAUUACAU-3'   (SEQ ID NO: 1060)
               3'-GUGUCAAAAACGAGACCACUUAAUGUA-5'   (SEQ ID NO: 268)
AAT-896 Target: 5'-CACAGTTTTTGCTCTGGTGAATTACAT-3'  (SEQ ID NO: 466)

5'-ACAGUUUUUGCUCUGGUGAAUUACAUC-3'   (SEQ ID NO: 1061)
               3'-UGUCAAAAACGAGACCACUUAAUGUAG-5'   (SEQ ID NO: 269)
AAT-897 Target: 5'-ACAGTTTTTGCTCTGGTGAATTACATC-3'  (SEQ ID NO: 467)

5'-CAGUUUUUGCUCUGGUGAAUUACAUCU-3'   (SEQ ID NO: 1062)
               3'-GUCAAAAACGAGACCACUUAAUGUAGA-5'   (SEQ ID NO: 270)
AAT-898 Target: 5'-CAGTTTTTGCTCTGGTGAATTACATCT-3'  (SEQ ID NO: 468)

5'-AGUUUUUGCUCUGGUGAAUUACAUCUU-3'   (SEQ ID NO: 1063)
               3'-UCAAAAACGAGACCACUUAAUGUAGAA-5'   (SEQ ID NO: 271)
AAT-899 Target: 5'-AGTTTTTGCTCTGGTGAATTACATCTT-3'  (SEQ ID NO: 469)

5'-UUAAAGGCAAAUGGGAGAGACCCUUUG-3'   (SEQ ID NO: 1064)
               3'-AAUUUCCGUUUACCCUCUCUGGGAAAC-5'   (SEQ ID NO: 272)
AAT-928 Target: 5'-TTAAAGGCAAATGGGAGAGACCCTTTG-3'  (SEQ ID NO: 470)

5'-UAAAGGCAAAUGGGAGAGACCCUUUGA-3'   (SEQ ID NO: 1065)
               3'-AUUUCCGUUUACCCUCUCUGGGAAACU-5'   (SEQ ID NO: 273)
AAT-929 Target: 5'-TAAAGGCAAATGGGAGAGACCCTTTGA-3'  (SEQ ID NO: 471)

5'-AAAGGCAAAUGGGAGAGACCCUUUGAA-3'   (SEQ ID NO: 1066)
               3'-UUUCCGUUUACCCUCUCUGGGAAACUU-5'   (SEQ ID NO: 274)
AAT-930 Target: 5'-AAAGGCAAATGGGAGAGACCCTTTGAA-3'  (SEQ ID NO: 472)

5'-AAGGCAAAUGGGAGAGACCCUUUGAAG-3'   (SEQ ID NO: 1067)
               3'-UUCCGUUUACCCUCUCUGGGAAACUUC-5'   (SEQ ID NO: 275)
AAT-931 Target: 5'-AAGGCAAATGGGAGAGACCCTTTGAAG-3'  (SEQ ID NO: 473)

5'-CGAGGAAGAGGACUUCCACGUGGACCA-3'   (SEQ ID NO: 1068)
               3'-GCUCCUUCUCCUGAAGGUGCACCUGGU-5'   (SEQ ID NO: 276)
AAT-968 Target: 5'-CGAGGAAGAGGACTTCCACGTGGACCA-3'  (SEQ ID NO: 474)

5'-GAGGAAGAGGACUUCCACGUGGACCAG-3'   (SEQ ID NO: 1069)
               3'-CUCCUUCUCCUGAAGGUGCACCUGGUC-5'   (SEQ ID NO: 277)
AAT-969 Target: 5'-GAGGAAGAGGACTTCCACGTGGACCAG-3'  (SEQ ID NO: 475)

5'-AGGAAGAGGACUUCCACGUGGACCAGG-3'   (SEQ ID NO: 1070)
               3'-UCCUUCUCCUGAAGGUGCACCUGGUCC-5'   (SEQ ID NO: 278)
AAT-970 Target: 5'-AGGAAGAGGACTTCCACGTGGACCAGG-3'  (SEQ ID NO: 476)

5'-GGAAGAGGACUUCCACGUGGACCAGGU-3'   (SEQ ID NO: 1071)
               3'-CCUUCUCCUGAAGGUGCACCUGGUCCA-5'   (SEQ ID NO: 279)
AAT-971 Target: 5'-GGAAGAGGACTTCCACGTGGACCAGGT-3'  (SEQ ID NO: 477)

5'-AAGAGGACUUCCACGUGGACCAGGUGA-3'   (SEQ ID NO: 1072)
               3'-UUCUCCUGAAGGUGCACCUGGUCCACU-5'   (SEQ ID NO: 280)
AAT-973 Target: 5'-AAGAGGACTTCCACGTGGACCAGGTGA-3'  (SEQ ID NO: 478)

5'-AGAGGACUUCCACGUGGACCAGGUGAC-3'   (SEQ ID NO: 1073)
               3'-UCUCCUGAAGGUGCACCUGGUCCACUG-5'   (SEQ ID NO: 281)
AAT-974 Target: 5'-AGAGGACTTCCACGTGGACCAGGTGAC-3'  (SEQ ID NO: 479)

5'-AGGACUUCCACGUGGACCAGGUGACCA-3'   (SEQ ID NO: 1074)
               3'-UCCUGAAGGUGCACCUGGUCCACUGGU-5'   (SEQ ID NO: 282)
AAT-976 Target: 5'-AGGACTTCCACGTGGACCAGGTGACCA-3'  (SEQ ID NO: 480)

5'-GCGUUUAGGCAUGUUUAACAUCCAGCA-3'   (SEQ ID NO: 1075)
               3'-CGCAAAUCCGUACAAAUUGUAGGUCGU-5'   (SEQ ID NO: 283)
AAT-1025 Target: 5'-GCGTTTAGGCATGTTTAACATCCAGCA-3' (SEQ ID NO: 481)

5'-CGUUUAGGCAUGUUUAACAUCCAGCAC-3'   (SEQ ID NO: 1076)
               3'-GCAAAUCCGUACAAAUUGUAGGUCGUG-5'   (SEQ ID NO: 284)
AAT-1026 Target: 5'-CGTTTAGGCATGTTTAACATCCAGCAC-3' (SEQ ID NO: 482)
```

TABLE 5-continued

Selected Human Anti-α-1 antitrypsin "Blunt/Blunt" DsiRNAs

```
              5'-AAGCUGUCCAGCUGGGUGCUGCUGAUG-3'    (SEQ ID NO: 1077)
              3'-UUCGACAGGUCGACCCACGACGACUAC-5'    (SEQ ID NO: 285)
AAT-1059 Target: 5'-AAGCTGTCCAGCTGGGTGCTGCTGATG-3'  (SEQ ID NO: 483)

5'-AGCUGUCCAGCUGGGUGCUGCUGAUGA-3'    (SEQ ID NO: 1078)
              3'-UCGACAGGUCGACCCACGACGACUACU-5'    (SEQ ID NO: 286)
AAT-1060 Target: 5'-AGCTGTCCAGCTGGGTGCTGCTGATGA-3'  (SEQ ID NO: 484)

5'-GGCAAUGCCACCGCCAUCUUCUUCCUG-3'    (SEQ ID NO: 1079)
              3'-CCGUUACGGUGGCGGUAGAAGAAGGAC-5'    (SEQ ID NO: 287)
AAT-1095 Target: 5'-GGCAATGCCACCGCCATCTTCTTCCTG-3'  (SEQ ID NO: 485)

5'-GCAAUGCCACCGCCAUCUUCUUCCUGC-3'    (SEQ ID NO: 1080)
              3'-CGUUACGGUGGCGGUAGAAGAAGGACG-5'    (SEQ ID NO: 288)
AAT-1096 Target: 5'-GCAATGCCACCGCCATCTTCTTCCTGC-3'  (SEQ ID NO: 486)

5'-UGCCACCGCCAUCUUCUUCCUGCCUGA-3'    (SEQ ID NO: 1081)
              3'-ACGGUGGCGGUAGAAGAAGGACGGACU-5'    (SEQ ID NO: 289)
AAT-1100 Target: 5'-TGCCACCGCCATCTTCTTCCTGCCTGA-3'  (SEQ ID NO: 487)

5'-GCCACCGCCAUCUUCUUCCUGCCUGAU-3'    (SEQ ID NO: 1082)
              3'-CGGUGGCGGUAGAAGAAGGACGGACUA-5'    (SEQ ID NO: 290)
AAT-1101 Target: 5'-GCCACCGCCATCTTCTTCCTGCCTGAT-3'  (SEQ ID NO: 488)

5'-CCACCGCCAUCUUCUUCCUGCCUGAUG-3'    (SEQ ID NO: 1083)
              3'-GGUGGCGGUAGAAGAAGGACGGACUAC-5'    (SEQ ID NO: 291)
AAT-1102 Target: 5'-CCACCGCCATCTTCTTCCTGCCTGATG-3'  (SEQ ID NO: 489)

5'-CACCGCCAUCUUCUUCCUGCCUGAUGA-3'    (SEQ ID NO: 1084)
              3'-GUGGCGGUAGAAGAAGGACGGACUACU-5'    (SEQ ID NO: 292)
AAT-1103 Target: 5'-CACCGCCATCTTCTTCCTGCCTGATGA-3'  (SEQ ID NO: 490)

5'-ACCGCCAUCUUCUUCCUGCCUGAUGAG-3'    (SEQ ID NO: 1085)
              3'-UGGCGGUAGAAGAAGGACGGACUACUC-5'    (SEQ ID NO: 293)
AAT-1104 Target: 5'-ACCGCCATCTTCTTCCTGCCTGATGAG-3'  (SEQ ID NO: 491)

5'-CCGCCAUCUUCUUCCUGCCUGAUGAGG-3'    (SEQ ID NO: 1086)
              3'-GGCGGUAGAAGAAGGACGGACUACUCC-5'    (SEQ ID NO: 294)
AAT-1105 Target: 5'-CCGCCATCTTCTTCCTGCCTGATGAGG-3'  (SEQ ID NO: 492)

5'-CCAUCUUCUUCCUGCCUGAUGAGGGGA-3'    (SEQ ID NO: 1087)
              3'-GGUAGAAGAAGGACGGACUACUCCCCU-5'    (SEQ ID NO: 295)
AAT-1108 Target: 5'-CCATCTTCTTCCTGCCTGATGAGGGGA-3'  (SEQ ID NO: 493)

5'-UUCUUCCUGCCUGAUGAGGGGAAACUA-3'    (SEQ ID NO: 1088)
              3'-AAGAAGGACGGACUACUCCCCUUUGAU-5'    (SEQ ID NO: 296)
AAT-1113 Target: 5'-TTCTTCCTGCCTGATGAGGGGAAACTA-3'  (SEQ ID NO: 494)

5'-UCUUCCUGCCUGAUGAGGGGAAACUAC-3'    (SEQ ID NO: 1089)
              3'-AGAAGGACGGACUACUCCCCUUUGAUG-5'    (SEQ ID NO: 297)
AAT-1114 Target: 5'-TCTTCCTGCCTGATGAGGGGAAACTAC-3'  (SEQ ID NO: 495)

5'-CUUCCUGCCUGAUGAGGGGAAACUACA-3'    (SEQ ID NO: 1090)
              3'-GAAGGACGGACUACUCCCCUUUGAUGU-5'    (SEQ ID NO: 298)
AAT-1115 Target: 5'-CTTCCTGCCTGATGAGGGGAAACTACA-3'  (SEQ ID NO: 496)

5'-UUCCUGCCUGAUGAGGGGAAACUACAG-3'    (SEQ ID NO: 1091)
              3'-AAGGACGGACUACUCCCCUUUGAUGUC-5'    (SEQ ID NO: 299)
AAT-1116 Target: 5'-TTCCTGCCTGATGAGGGGAAACTACAG-3'  (SEQ ID NO: 497)

5'-UCCUGCCUGAUGAGGGGAAACUACAGC-3'    (SEQ ID NO: 1092)
              3'-AGGACGGACUACUCCCCUUUGAUGUCG-5'    (SEQ ID NO: 300)
AAT-1117 Target: 5'-TCCTGCCTGATGAGGGGAAACTACAGC-3'  (SEQ ID NO: 498)

5'-CCUGCCUGAUGAGGGGAAACUACAGCA-3'    (SEQ ID NO: 1093)
              3'-GGACGGACUACUCCCCUUUGAUGUCGU-5'    (SEQ ID NO: 301)
AAT-1118 Target: 5'-CCTGCCTGATGAGGGGAAACTACAGCA-3'  (SEQ ID NO: 499)

5'-ACAGCACCUGGAAAAUGAACUCACCCA-3'    (SEQ ID NO: 1094)
              3'-UGUCGUGGACCUUUUACUUGAGUGGGU-5'    (SEQ ID NO: 302)
AAT-1139 Target: 5'-ACAGCACCTGGAAAATGAACTCACCCA-3'  (SEQ ID NO: 500)

5'-CAGCACCUGGAAAAUGAACUCACCCAC-3'    (SEQ ID NO: 1095)
              3'-GUCGUGGACCUUUUACUUGAGUGGGUG-5'    (SEQ ID NO: 303)
AAT-1140 Target: 5'-CAGCACCTGGAAAATGAACTCACCCAC-3'  (SEQ ID NO: 501)
```

TABLE 5-continued

Selected Human Anti-α-1 antitrypsin "Blunt/Blunt" DsiRNAs

```
                5'-AGCACCUGGAAAAUGAACUCACCCACG-3'      (SEQ ID NO: 1096)
                3'-UCGUGGACCUUUUACUUGAGUGGGUGC-5'      (SEQ ID NO: 304)
AAT-1141 Target: 5'-AGCACCTGGAAAATGAACTCACCCACG-3'     (SEQ ID NO: 502)

5'-GCACCUGGAAAAUGAACUCACCCACGA-3'      (SEQ ID NO: 1097)
                3'-CGUGGACCUUUUACUUGAGUGGGUGCU-5'      (SEQ ID NO: 305)
AAT-1142 Target: 5'-GCACCTGGAAAATGAACTCACCCACGA-3'     (SEQ ID NO: 503)

5'-CACCUGGAAAAUGAACUCACCCACGAU-3'      (SEQ ID NO: 1098)
                3'-GUGGACCUUUUACUUGAGUGGGUGCUA-5'      (SEQ ID NO: 306)
AAT-1143 Target: 5'-CACCTGGAAAATGAACTCACCCACGAT-3'     (SEQ ID NO: 504)

5'-CGAUAUCAUCACCAAGUUCCUGGAAAA-3'      (SEQ ID NO: 1099)
                3'-GCUAUAGUAGUGGUUCAAGGACCUUUU-5'      (SEQ ID NO: 307)
AAT-1166 Target: 5'-CGATATCATCACCAAGTTCCTGGAAAA-3'     (SEQ ID NO: 505)

5'-GAUAUCAUCACCAAGUUCCUGGAAAAU-3'      (SEQ ID NO: 1100)
                3'-CUAUAGUAGUGGUUCAAGGACCUUUUA-5'      (SEQ ID NO: 308)
AAT-1167 Target: 5'-GATATCATCACCAAGTTCCTGGAAAAT-3'     (SEQ ID NO: 506)

5'-AUAUCAUCACCAAGUUCCUGGAAAAUG-3'      (SEQ ID NO: 1101)
                3'-UAUAGUAGUGGUUCAAGGACCUUUUAC-5'      (SEQ ID NO: 309)
AAT-1168 Target: 5'-ATATCATCACCAAGTTCCTGGAAAATG-3'     (SEQ ID NO: 507)

5'-UAUCAUCACCAAGUUCCUGGAAAAUGA-3'      (SEQ ID NO: 1102)
                3'-AUAGUAGUGGUUCAAGGACCUUUUACU-5'      (SEQ ID NO: 310)
AAT-1169 Target: 5'-TATCATCACCAAGTTCCTGGAAAATGA-3'     (SEQ ID NO: 508)

5'-AUCAUCACCAAGUUCCUGGAAAAUGAA-3'      (SEQ ID NO: 1103)
                3'-UAGUAGUGGUUCAAGGACCUUUUACUU-5'      (SEQ ID NO: 311)
AAT-1170 Target: 5'-ATCATCACCAAGTTCCTGGAAAATGAA-3'     (SEQ ID NO: 509)

5'-UCAUCACCAAGUUCCUGGAAAAUGAAG-3'      (SEQ ID NO: 1104)
                3'-AGUAGUGGUUCAAGGACCUUUUACUUC-5'      (SEQ ID NO: 312)
AAT-1171 Target: 5'-TCATCACCAAGTTCCTGGAAAATGAAG-3'     (SEQ ID NO: 510)

5'-CAUCACCAAGUUCCUGGAAAAUGAAGA-3'      (SEQ ID NO: 1105)
                3'-GUAGUGGUUCAAGGACCUUUUACUUCU-5'      (SEQ ID NO: 313)
AAT-1172 Target: 5'-CATCACCAAGTTCCTGGAAAATGAAGA-3'     (SEQ ID NO: 511)

5'-AUCACCAAGUUCCUGGAAAAUGAAGAC-3'      (SEQ ID NO: 1106)
                3'-UAGUGGUUCAAGGACCUUUUACUUCUG-5'      (SEQ ID NO: 314)
AAT-1173 Target: 5'-ATCACCAAGTTCCTGGAAAATGAAGAC-3'     (SEQ ID NO: 512)

5'-UCACCAAGUUCCUGGAAAAUGAAGACA-3'      (SEQ ID NO: 1107)
                3'-AGUGGUUCAAGGACCUUUUACUUCUGU-5'      (SEQ ID NO: 315)
AAT-1174 Target: 5'-TCACCAAGTTCCTGGAAAATGAAGACA-3'     (SEQ ID NO: 513)

5'-CACCAAGUUCCUGGAAAAUGAAGACAG-3'      (SEQ ID NO: 1108)
                3'-GUGGUUCAAGGACCUUUUACUUCUGUC-5'      (SEQ ID NO: 316)
AAT-1175 Target: 5'-CACCAAGTTCCTGGAAAATGAAGACAG-3'     (SEQ ID NO: 514)

5'-UAAGGUCUUCAGCAAUGGGGCUGACCU-3'      (SEQ ID NO: 1109)
                3'-AUUCCAGAAGUCGUUACCCCGACUGGA-5'      (SEQ ID NO: 317)
AAT-1286 Target: 5'-TAAGGTCTTCAGCAATGGGGCTGACCT-3'     (SEQ ID NO: 515)

5'-AGCAAUGGGGCUGACCUCUCCGGGGUC-3'      (SEQ ID NO: 1110)
                3'-UCGUUACCCCGACUGGAGAGGCCCCAG-5'      (SEQ ID NO: 318)
AAT-1296 Target: 5'-AGCAATGGGGCTGACCTCTCCGGGTC-3'      (SEQ ID NO: 516)

5'-GCAAUGGGGCUGACCUCUCCGGGGUCA-3'      (SEQ ID NO: 1111)
                3'-CGUUACCCCGACUGGAGAGGCCCCAGU-5'      (SEQ ID NO: 319)
AAT-1297 Target: 5'-GCAATGGGGCTGACCTCTCCGGGTCA-3'      (SEQ ID NO: 517)

5'-CAAUGGGGCUGACCUCUCCGGGGUCAC-3'      (SEQ ID NO: 1112)
                3'-GUUACCCCGACUGGAGAGGCCCCAGUG-5'      (SEQ ID NO: 320)
AAT-1298 Target: 5'-CAATGGGGCTGACCTCTCCGGGTCAC-3'      (SEQ ID NO: 518)

5'-CAGAGGAGGCACCCCUGAAGCUCUCCA-3'      (SEQ ID NO: 1113)
                3'-GUCUCCUCCGUGGGGACUUCGAGAGGU-5'      (SEQ ID NO: 321)
AAT-1324 Target: 5'-CAGAGGAGGCACCCCTGAAGCTCTCCA-3'     (SEQ ID NO: 519)

5'-GAGGAGGCACCCCUGAAGCUCUCCAAG-3'      (SEQ ID NO: 1114)
                3'-CUCCUCCGUGGGGACUUCGAGAGGUUC-5'      (SEQ ID NO: 322)
AAT-1326 Target: 5'-GAGGAGGCACCCCTGAAGCTCTCCAAG-3'     (SEQ ID NO: 520)
```

TABLE 5-continued

Selected Human Anti-α-1 antitrypsin "Blunt/Blunt" DsiRNAs

```
            5'-CCCUGAAGCUCUCCAAGGCCGUGCAUA-3'   (SEQ ID NO: 1115)
            3'-GGGACUUCGAGAGGUUCCGGCACGUAU-5'   (SEQ ID NO: 323)
AAT-1336 Target: 5'-CCCTGAAGCTCTCCAAGGCCGTGCATA-3'  (SEQ ID NO: 521)

5'-GCCGUGCAUAAGGCUGUGCUGACCAUC-3'   (SEQ ID NO: 1116)
            3'-CGGCACGUAUUCCGACACGACUGGUAG-5'   (SEQ ID NO: 324)
AAT-1353 Target: 5'-GCCGTGCATAAGGCTGTGCTGACCATC-3'  (SEQ ID NO: 522)

5'-CCGUGCAUAAGGCUGUGCUGACCAUCG-3'   (SEQ ID NO: 1117)
            3'-GGCACGUAUUCCGACACGACUGGUAGC-5'   (SEQ ID NO: 325)
AAT-1354 Target: 5'-CCGTGCATAAGGCTGTGCTGACCATCG-3'  (SEQ ID NO: 523)

5'-CGUGCAUAAGGCUGUGCUGACCAUCGA-3'   (SEQ ID NO: 1118)
            3'-GCACGUAUUCCGACACGACUGGUAGCU-5'   (SEQ ID NO: 326)
AAT-1355 Target: 5'-CGTGCATAAGGCTGTGCTGACCATCGA-3'  (SEQ ID NO: 524)

5'-GUGCAUAAGGCUGUGCUGACCAUCGAC-3'   (SEQ ID NO: 1119)
            3'-CACGUAUUCCGACACGACUGGUAGCUG-5'   (SEQ ID NO: 327)
AAT-1356 Target: 5'-GTGCATAAGGCTGTGCTGACCATCGAC-3'  (SEQ ID NO: 525)

5'-UGCAUAAGGCUGUGCUGACCAUCGACG-3'   (SEQ ID NO: 1120)
            3'-ACGUAUUCCGACACGACUGGUAGCUGC-5'   (SEQ ID NO: 328)
AAT-1357 Target: 5'-TGCATAAGGCTGTGCTGACCATCGACG-3'  (SEQ ID NO: 526)

5'-GCAUAAGGCUGUGCUGACCAUCGACGA-3'   (SEQ ID NO: 1121)
            3'-CGUAUUCCGACACGACUGGUAGCUGCU-5'   (SEQ ID NO: 329)
AAT-1358 Target: 5'-GCATAAGGCTGTGCTGACCATCGACGA-3'  (SEQ ID NO: 527)

5'-CAUAAGGCUGUGCUGACCAUCGACGAG-3'   (SEQ ID NO: 1122)
            3'-GUAUUCCGACACGACUGGUAGCUGCUC-5'   (SEQ ID NO: 330)
AAT-1359 Target: 5'-CATAAGGCTGTGCTGACCATCGACGAG-3'  (SEQ ID NO: 528)

5'-AUAAGGCUGUGCUGACCAUCGACGAGA-3'   (SEQ ID NO: 1123)
            3'-UAUUCCGACACGACUGGUAGCUGCUCU-5'   (SEQ ID NO: 331)
AAT-1360 Target: 5'-ATAAGGCTGTGCTGACCATCGACGAGA-3'  (SEQ ID NO: 529)

5'-UAAGGCUGUGCUGACCAUCGACGAGAA-3'   (SEQ ID NO: 1124)
            3'-AUUCCGACACGACUGGUAGCUGCUCUU-5'   (SEQ ID NO: 332)
AAT-1361 Target: 5'-TAAGGCTGTGCTGACCATCGACGAGAA-3'  (SEQ ID NO: 530)

5'-GGACUGAAGCUGCUGGGGCCAUGUUUU-3'   (SEQ ID NO: 1125)
            3'-CCUGACUUCGACGACCCCGGUACAAAA-5'   (SEQ ID NO: 333)
AAT-1390 Target: 5'-GGACTGAAGCTGCTGGGGCCATGTTTT-3'  (SEQ ID NO: 531)

5'-GACUGAAGCUGCUGGGGCCAUGUUUUU-3'   (SEQ ID NO: 1126)
            3'-CUGACUUCGACGACCCCGGUACAAAAA-5'   (SEQ ID NO: 334)
AAT-1391 Target: 5'-GACTGAAGCTGCTGGGGCCATGTTTTT-3'  (SEQ ID NO: 532)

5'-ACUGAAGCUGCUGGGGCCAUGUUUUUA-3'   (SEQ ID NO: 1127)
            3'-UGACUUCGACGACCCCGGUACAAAAAU-5'   (SEQ ID NO: 335)
AAT-1392 Target: 5'-ACTGAAGCTGCTGGGGCCATGTTTTTA-3'  (SEQ ID NO: 533)

5'-CUGAAGCUGCUGGGGCCAUGUUUUUAG-3'   (SEQ ID NO: 1128)
            3'-GACUUCGACGACCCCGGUACAAAAAUC-5'   (SEQ ID NO: 336)
AAT-1393 Target: 5'-CTGAAGCTGCTGGGGCCATGTTTTTAG-3'  (SEQ ID NO: 534)

5'-UGAAGCUGCUGGGGCCAUGUUUUUAGA-3'   (SEQ ID NO: 1129)
            3'-ACUUCGACGACCCCGGUACAAAAAUCU-5'   (SEQ ID NO: 337)
AAT-1394 Target: 5'-TGAAGCTGCTGGGGCCATGTTTTTAGA-3'  (SEQ ID NO: 535)

5'-GAAGCUGCUGGGGCCAUGUUUUUAGAG-3'   (SEQ ID NO: 1130)
            3'-CUUCGACGACCCCGGUACAAAAAUCUC-5'   (SEQ ID NO: 338)
AAT-1395 Target: 5'-GAAGCTGCTGGGGCCATGTTTTTAGAG-3'  (SEQ ID NO: 536)

5'-GGGCCAUGUUUUUAGAGGCCAUACCCA-3'   (SEQ ID NO: 1131)
            3'-CCCGGUACAAAAAUCUCCGGUAUGGGU-5'   (SEQ ID NO: 339)
AAT-1405 Target: 5'-GGGCCATGTTTTTAGAGGCCATACCCA-3'  (SEQ ID NO: 537)

5'-GGCCAUGUUUUUAGAGGCCAUACCCAU-3'   (SEQ ID NO: 1132)
            3'-CCGGUACAAAAAUCUCCGGUAUGGGUA-5'   (SEQ ID NO: 340)
AAT-1406 Target: 5'-GGCCATGTTTTTAGAGGCCATACCCAT-3'  (SEQ ID NO: 538)

5'-GCCAUGUUUUUAGAGGCCAUACCCAUG-3'   (SEQ ID NO: 1133)
            3'-CGGUACAAAAAUCUCCGGUAUGGGUAC-5'   (SEQ ID NO: 341)
AAT-1407 Target: 5'-GCCATGTTTTTAGAGGCCATACCCATG-3'  (SEQ ID NO: 539)
```

TABLE 5-continued

Selected Human Anti-α-1 antitrypsin "Blunt/Blunt" DsiRNAs

```
                5'-CCAUGUUUUAGAGGCCAUACCCAUGU-3'      (SEQ ID NO: 1134)
                3'-GGUACAAAAAUCUCCGGUAUGGGUACA-5'     (SEQ ID NO: 342)
AAT-1408 Target: 5'-CCATGTTTTAGAGGCCATACCCATGT-3'    (SEQ ID NO: 540)

5'-CAUGUUUUAGAGGCCAUACCCAUGUC-3'     (SEQ ID NO: 1135)
                3'-GUACAAAAAUCUCCGGUAUGGGUACAG-5'    (SEQ ID NO: 343)
AAT-1409 Target: 5'-CATGTTTTAGAGGCCATACCCATGTC-3'    (SEQ ID NO: 541)

5'-AUGUUUUAGAGGCCAUACCCAUGUCU-3'     (SEQ ID NO: 1136)
                3'-UACAAAAAUCUCCGGUAUGGGUACAGA-5'    (SEQ ID NO: 344)
AAT-1410 Target: 5'-ATGTTTTAGAGGCCATACCCATGTCT-3'    (SEQ ID NO: 542)

5'-UGUUUUAGAGGCCAUACCCAUGUCUA-3'     (SEQ ID NO: 1137)
                3'-ACAAAAAUCUCCGGUAUGGGUACAGAU-5'    (SEQ ID NO: 345)
AAT-1411 Target: 5'-TGTTTTAGAGGCCATACCCATGTCTA-3'    (SEQ ID NO: 543)

5'-GUUUUAGAGGCCAUACCCAUGUCUAU-3'     (SEQ ID NO: 1138)
                3'-CAAAAAUCUCCGGUAUGGGUACAGAUA-5'    (SEQ ID NO: 346)
AAT-1412 Target: 5'-GTTTTAGAGGCCATACCCATGTCTAT-3'    (SEQ ID NO: 544)

5'-UUUUAGAGGCCAUACCCAUGUCUAUC-3'     (SEQ ID NO: 1139)
                3'-AAAAAUCUCCGGUAUGGGUACAGAUAG-5'    (SEQ ID NO: 347)
AAT-1413 Target: 5'-TTTTTAGAGGCCATACCCATGTCTATC-3'   (SEQ ID NO: 545)

5'-UUUUAGAGGCCAUACCCAUGUCUAUCC-3'    (SEQ ID NO: 1140)
                3'-AAAAUCUCCGGUAUGGGUACAGAUAGG-5'    (SEQ ID NO: 348)
AAT-1414 Target: 5'-TTTTAGAGGCCATACCCATGTCTATCC-3'   (SEQ ID NO: 546)

5'-UUUAGAGGCCAUACCCAUGUCUAUCCC-3'    (SEQ ID NO: 1141)
                3'-AAAUCUCCGGUAUGGGUACAGAUAGGG-5'    (SEQ ID NO: 349)
AAT-1415 Target: 5'-TTTAGAGGCCATACCCATGTCTATCCC-3'   (SEQ ID NO: 547)

5'-UUAGAGGCCAUACCCAUGUCUAUCCCC-3'    (SEQ ID NO: 1142)
                3'-AAUCUCCGGUAUGGGUACAGAUAGGGG-5'    (SEQ ID NO: 350)
AAT-1416 Target: 5'-TTAGAGGCCATACCCATGTCTATCCCC-3'   (SEQ ID NO: 548)

5'-AAGUUCAACAAACCCUUUGUCUUCUUA-3'    (SEQ ID NO: 1143)
                3'-UUCAAGUUGUUUGGGAAACAGAAGAAU-5'    (SEQ ID NO: 351)
AAT-1452 Target: 5'-AAGTTCAACAAACCCTTTGTCTTCTTA-3'   (SEQ ID NO: 549)

5'-AGUUCAACAAACCCUUUGUCUUCUUAA-3'    (SEQ ID NO: 1144)
                3'-UCAAGUUGUUUGGGAAACAGAAGAAUU-5'    (SEQ ID NO: 352)
AAT-1453 Target: 5'-AGTTCAACAAACCCTTTGTCTTCTTAA-3'   (SEQ ID NO: 550)

5'-GUUCAACAAACCCUUUGUCUUCUUAAU-3'    (SEQ ID NO: 1145)
                3'-CAAGUUGUUUGGGAAACAGAAGAAUUA-5'    (SEQ ID NO: 353)
AAT-1454 Target: 5'-GTTCAACAAACCCTTTGTCTTCTTAAT-3'   (SEQ ID NO: 551)

5'-UUCAACAAACCCUUUGUCUUCUUAAUG-3'    (SEQ ID NO: 1146)
                3'-AAGUUGUUUGGGAAACAGAAGAAUUAC-5'    (SEQ ID NO: 354)
AAT-1455 Target: 5'-TTCAACAAACCCTTTGTCTTCTTAATG-3'   (SEQ ID NO: 552)

5'-UCAACAAACCCUUUGUCUUCUUAAUGA-3'    (SEQ ID NO: 1147)
                3'-AGUUGUUUGGGAAACAGAAGAAUUACU-5'    (SEQ ID NO: 355)
AAT-1456 Target: 5'-TCAACAAACCCTTTGTCTTCTTAATGA-3'   (SEQ ID NO: 553)

5'-CAACAAACCCUUUGUCUUCUUAAUGAU-3'    (SEQ ID NO: 1148)
                3'-GUUGUUUGGGAAACAGAAGAAUUACUA-5'    (SEQ ID NO: 356)
AAT-1457 Target: 5'-CAACAAACCCTTTGTCTTCTTAATGAT-3'   (SEQ ID NO: 554)

5'-AACAAACCCUUUGUCUUCUUAAUGAUU-3'    (SEQ ID NO: 1149)
                3'-UUGUUUGGGAAACAGAAGAAUUACUAA-5'    (SEQ ID NO: 357)
AAT-1458 Target: 5'-AACAAACCCTTTGTCTTCTTAATGATT-3'   (SEQ ID NO: 555)

5'-ACAAACCCUUUGUCUUCUUAAUGAUUG-3'    (SEQ ID NO: 1150)
                3'-UGUUUGGGAAACAGAAGAAUUACUAAC-5'    (SEQ ID NO: 358)
AAT-1459 Target: 5'-ACAAACCCTTTGTCTTCTTAATGATTG-3'   (SEQ ID NO: 556)

5'-CAAACCCUUUGUCUUCUUAAUGAUUGA-3'    (SEQ ID NO: 1151)
                3'-GUUUGGGAAACAGAAGAAUUACUAACU-5'    (SEQ ID NO: 359)
AAT-1460 Target: 5'-CAAACCCTTTGTCTTCTTAATGATTGA-3'   (SEQ ID NO: 557)

5'-AAAAUACCAAGUCUCCCCUCUUCAUGG-3'    (SEQ ID NO: 1152)
                3'-UUUUAUGGUUCAGAGGGGAGAAGUACC-5'    (SEQ ID NO: 360)
AAT-1489 Target: 5'-AAAATACCAAGTCTCCCCTCTTCATGG-3'   (SEQ ID NO: 558)
```

TABLE 5-continued

Selected Human Anti-α-1 antitrypsin "Blunt/Blunt" DsiRNAs

```
              5'-AAAUACCAAGUCUCCCCUCUUCAUGGG-3'       (SEQ ID NO: 1153)
              3'-UUUAUGGUUCAGAGGGGAGAAGUACCC-5'       (SEQ ID NO: 361)
AAT-1490 Target: 5'-AAATACCAAGTCTCCCCTCTTCATGGG-3'    (SEQ ID NO: 559)

5'-AAUACCAAGUCUCCCCUCUUCAUGGGA-3'       (SEQ ID NO: 1154)
              3'-UUAUGGUUCAGAGGGGAGAAGUACCCU-5'       (SEQ ID NO: 362)
AAT-1491 Target: 5'-AATACCAAGTCTCCCCTCTTCATGGGA-3'    (SEQ ID NO: 560)

5'-AUACCAAGUCUCCCCUCUUCAUGGGAA-3'       (SEQ ID NO: 1155)
              3'-UAUGGUUCAGAGGGGAGAAGUACCCUU-5'       (SEQ ID NO: 363)
AAT-1492 Target: 5'-ATACCAAGTCTCCCCTCTTCATGGGAA-3'    (SEQ ID NO: 561)

5'-UACCAAGUCUCCCCUCUUCAUGGGAAA-3'       (SEQ ID NO: 1156)
              3'-AUGGUUCAGAGGGGAGAAGUACCCUUU-5'       (SEQ ID NO: 364)
AAT-1493 Target: 5'-TACCAAGTCTCCCCTCTTCATGGGAAA-3'    (SEQ ID NO: 562)

5'-ACCAAGUCUCCCCUCUUCAUGGGAAAA-3'       (SEQ ID NO: 1157)
              3'-UGGUUCAGAGGGGAGAAGUACCCUUUU-5'       (SEQ ID NO: 365)
AAT-1494 Target: 5'-ACCAAGTCTCCCCTCTTCATGGGAAAA-3'    (SEQ ID NO: 563)

5'-CCAAGUCUCCCCUCUUCAUGGGAAAAG-3'       (SEQ ID NO: 1158)
              3'-GGUUCAGAGGGGAGAAGUACCCUUUUC-5'       (SEQ ID NO: 366)
AAT-1495 Target: 5'-CCAAGTCTCCCCTCTTCATGGGAAAAG-3'    (SEQ ID NO: 564)

5'-CAAGUCUCCCCUCUUCAUGGGAAAAGU-3'       (SEQ ID NO: 1159)
              3'-GUUCAGAGGGGAGAAGUACCCUUUUCA-5'       (SEQ ID NO: 367)
AAT-1496 Target: 5'-CAAGTCTCCCCTCTTCATGGGAAAAGT-3'    (SEQ ID NO: 565)

5'-AAGUCUCCCCUCUUCAUGGGAAAAGUG-3'       (SEQ ID NO: 1160)
              3'-UUCAGAGGGGAGAAGUACCCUUUUCAC-5'       (SEQ ID NO: 368)
AAT-1497 Target: 5'-AAGTCTCCCCTCTTCATGGGAAAAGTG-3'    (SEQ ID NO: 566)

5'-GUCUCCCCUCUUCAUGGGAAAAGUGGU-3'       (SEQ ID NO: 1161)
              3'-CAGAGGGGAGAAGUACCCUUUUCACCA-5'       (SEQ ID NO: 369)
AAT-1499 Target: 5'-GTCTCCCCTCTTCATGGGAAAAGTGGT-3'    (SEQ ID NO: 567)

5'-CUCCCCUCUUCAUGGGAAAAGUGGUGA-3'       (SEQ ID NO: 1162)
              3'-GAGGGGAGAAGUACCCUUUUCACCACU-5'       (SEQ ID NO: 370)
AAT-1501 Target: 5'-CTCCCCTCTTCATGGGAAAAGTGGTGA-3'    (SEQ ID NO: 568)

5'-UCCCCUCUUCAUGGGAAAAGUGGUGAA-3'       (SEQ ID NO: 1163)
              3'-AGGGGAGAAGUACCCUUUUCACCACUU-5'       (SEQ ID NO: 371)
AAT-1502 Target: 5'-TCCCCTCTTCATGGGAAAAGTGGTGAA-3'    (SEQ ID NO: 569)

5'-CCCCUCUUCAUGGGAAAAGUGGUGAAU-3'       (SEQ ID NO: 1164)
              3'-GGGGAGAAGUACCCUUUUCACCACUUA-5'       (SEQ ID NO: 372)
AAT-1503 Target: 5'-CCCCTCTTCATGGGAAAAGTGGTGAAT-3'    (SEQ ID NO: 570)

5'-CCCUCUUCAUGGGAAAAGUGGUGAAUC-3'       (SEQ ID NO: 1165)
              3'-GGGAGAAGUACCCUUUUCACCACUUAG-5'       (SEQ ID NO: 373)
AAT-1504 Target: 5'-CCCTCTTCATGGGAAAAGTGGTGAATC-3'    (SEQ ID NO: 571)

5'-CCUCUUCAUGGGAAAAGUGGUGAAUCC-3'       (SEQ ID NO: 1166)
              3'-GGAGAAGUACCCUUUUCACCACUUAGG-5'       (SEQ ID NO: 374)
AAT-1505 Target: 5'-CCTCTTCATGGGAAAAGTGGTGAATCC-3'    (SEQ ID NO: 572)

5'-CUCUUCAUGGGAAAAGUGGUGAAUCCC-3'       (SEQ ID NO: 1167)
              3'-GAGAAGUACCCUUUUCACCACUUAGGG-5'       (SEQ ID NO: 375)
AAT-1506 Target: 5'-CTCTTCATGGGAAAAGTGGTGAATCCC-3'    (SEQ ID NO: 573)

5'-UCUUCAUGGGAAAAGUGGUGAAUCCCA-3'       (SEQ ID NO: 1168)
              3'-AGAAGUACCCUUUUCACCACUUAGGGU-5'       (SEQ ID NO: 376)
AAT-1507 Target: 5'-TCTTCATGGGAAAAGTGGTGAATCCCA-3'    (SEQ ID NO: 574)

5'-CUUCAUGGGAAAAGUGGUGAAUCCCAC-3'       (SEQ ID NO: 1169)
              3'-GAAGUACCCUUUUCACCACUUAGGGUG-5'       (SEQ ID NO: 377)
AAT-1508 Target: 5'-CTTCATGGGAAAAGTGGTGAATCCCAC-3'    (SEQ ID NO: 575)

5'-UUCAUGGGAAAAGUGGUGAAUCCCACC-3'       (SEQ ID NO: 1170)
              3'-AAGUACCCUUUUCACCACUUAGGGUGG-5'       (SEQ ID NO: 378)
AAT-1509 Target: 5'-TTCATGGGAAAAGTGGTGAATCCCACC-3'    (SEQ ID NO: 576)

5'-UCAUGGGAAAAGUGGUGAAUCCCACCC-3'       (SEQ ID NO: 1171)
              3'-AGUACCCUUUUCACCACUUAGGGUGGG-5'       (SEQ ID NO: 379)
AAT-1510 Target: 5'-TCATGGGAAAAGTGGTGAATCCCACCC-3'    (SEQ ID NO: 577)
```

TABLE 5-continued

Selected Human Anti-α-1 antitrypsin "Blunt/Blunt" DsiRNAs

```
              5'-CAUGGGAAAAGUGGUGAAUCCCACCCA-3'    (SEQ ID NO: 1172)
              3'-GUACCCUUUUCACCACUUAGGGUGGGU-5'    (SEQ ID NO: 380)
AAT-1511 Target: 5'-CATGGGAAAAGTGGTGAATCCCACCCA-3' (SEQ ID NO: 578)

5'-AUGGGAAAAGUGGUGAAUCCCACCCAA-3'    (SEQ ID NO: 1173)
              3'-UACCCUUUUCACCACUUAGGGUGGGUU-5'    (SEQ ID NO: 381)
AAT-1512 Target: 5'-ATGGGAAAAGTGGTGAATCCCACCCAA-3' (SEQ ID NO: 579)

5'-UGGGAAAAGUGGUGAAUCCCACCCAAA-3'    (SEQ ID NO: 1174)
              3'-ACCCUUUUCACCACUUAGGGUGGGUUU-5'    (SEQ ID NO: 382)
AAT-1513 Target: 5'-TGGGAAAAGTGGTGAATCCCACCCAAA-3' (SEQ ID NO: 580)

5'-GGGAAAAGUGGUGAAUCCCACCCAAAA-3'    (SEQ ID NO: 1175)
              3'-CCCUUUUCACCACUUAGGGUGGGUUUU-5'    (SEQ ID NO: 383)
AAT-1514 Target: 5'-GGGAAAAGTGGTGAATCCCACCCAAAA-3' (SEQ ID NO: 581)

5'-GGAAAAGUGGUGAAUCCCACCCAAAAA-3'    (SEQ ID NO: 1176)
              3'-CCUUUUCACCACUUAGGGUGGGUUUUU-5'    (SEQ ID NO: 384)
AAT-1515 Target: 5'-GGAAAAGTGGTGAATCCCACCCAAAAA-3' (SEQ ID NO: 582)

5'-GAAAAGUGGUGAAUCCCACCCAAAAAU-3'    (SEQ ID NO: 1177)
              3'-CUUUUCACCACUUAGGGUGGGUUUUUA-5'    (SEQ ID NO: 385)
AAT-1516 Target: 5'-GAAAAGTGGTGAATCCCACCCAAAAAT-3' (SEQ ID NO: 583)

5'-AAAAGUGGUGAAUCCCACCCAAAAAUA-3'    (SEQ ID NO: 1178)
              3'-UUUUCACCACUUAGGGUGGGUUUUUAU-5'    (SEQ ID NO: 386)
AAT-1517 Target: 5'-AAAAGTGGTGAATCCCACCCAAAAATA-3' (SEQ ID NO: 584)

5'-UUCGAUAGUUCAAAAUGGUGAAAUUAG-3'    (SEQ ID NO: 1179)
              3'-AAGCUAUCAAGUUUUACCACUUUAAUC-5'    (SEQ ID NO: 387)
AAT-2872 Target: 5'-TTCGATAGTTCAAAATGGTGAAATTAG-3' (SEQ ID NO: 585)

5'-UUCAAAAUGGUGAAAUUAGCAAUUCUA-3'    (SEQ ID NO: 1180)
              3'-AAGUUUUACCACUUUAAUCGUUAAGAU-5'    (SEQ ID NO: 388)
AAT-2880 Target: 5'-TTCAAAATGGTGAAATTAGCAATTCTA-3' (SEQ ID NO: 586)

5'-AGUUGGUAUGAUGUUCAAGUUAGAUAA-3'    (SEQ ID NO: 1181)
              3'-UCAACCAUACUACAAGUUCAAUCUAUU-5'    (SEQ ID NO: 389)
AAT-3167 Target: 5'-AGTTGGTATGATGTTCAAGTTAGATAA-3' (SEQ ID NO: 587)

5'-UUGGUAUGAUGUUCAAGUUAGAUAACA-3'    (SEQ ID NO: 1182)
              3'-AACCAUACUACAAGUUCAAUCUAUUGU-5'    (SEQ ID NO: 390)
AAT-3169 Target: 5'-TTGGTATGATGTTCAAGTTAGATAACA-3' (SEQ ID NO: 588)

5'-UGGUAUGAUGUUCAAGUUAGAUAACAA-3'    (SEQ ID NO: 1183)
              3'-ACCAUACUACAAGUUCAAUCUAUUGUU-5'    (SEQ ID NO: 391)
AAT-3170 Target: 5'-TGGTATGATGTTCAAGTTAGATAACAA-3' (SEQ ID NO: 589)

5'-GUAUGAUGUUCAAGUUAGAUAACAAAA-3'    (SEQ ID NO: 1184)
              3'-CAUACUACAAGUUCAAUCUAUUGUUUU-5'    (SEQ ID NO: 392)
AAT-3172 Target: 5'-GTATGATGTTCAAGTTAGATAACAAAA-3' (SEQ ID NO: 590)

5'-UGAUGUUCAAGUUAGAUAACAAAAUGU-3'    (SEQ ID NO: 1185)
              3'-ACUACAAGUUCAAUCUAUUGUUUUACA-5'    (SEQ ID NO: 393)
AAT-3175 Target: 5'-TGATGTTCAAGTTAGATAACAAAATGT-3' (SEQ ID NO: 591)

5'-UUCAAGUUAGAUAACAAAAUGUUUAUA-3'    (SEQ ID NO: 1186)
              3'-AAGUUCAAUCUAUUGUUUUACAAAUAU-5'    (SEQ ID NO: 394)
AAT-3180 Target: 5'-TTCAAGTTAGATAACAAAATGTTTATA-3' (SEQ ID NO: 592)

5'-UCAAGUUAGAUAACAAAAUGUUUAUAC-3'    (SEQ ID NO: 1187)
              3'-AGUUCAAUCUAUUGUUUUACAAAUAUG-5'    (SEQ ID NO: 395)
AAT-3181 Target: 5'-TCAAGTTAGATAACAAAATGTTTATAC-3' (SEQ ID NO: 593)

5'-CAAGUUAGAUAACAAAAUGUUUAUACC-3'    (SEQ ID NO: 1188)
              3'-GUUCAAUCUAUUGUUUUACAAAUAUGG-5'    (SEQ ID NO: 396)
AAT-3182 Target: 5'-CAAGTTAGATAACAAAATGTTTATACC-3' (SEQ ID NO: 594)
```

TABLE 6

DsiRNA Component 19 Nucleotide Target Sequences in α-1 antitrypsin mRNA

| | | | |
|---|---|---|---|
| AAT-395 19 nt Target #1: | 5'-CAUCCCACCAUGAUCAGGA-3' | (SEQ ID NO: 1189) |
| AAT-395 19 nt Target #2: | 5'-ACAUCCCACCAUGAUCAGG-3' | (SEQ ID NO: 1387) |
| AAT-395 19 nt Target #3: | 5'-UACAUCCCACCAUGAUCAG-3' | (SEQ ID NO: 1585) |
| AAT-475 19 nt Target #1: | 5'-CAGCUGGCACACCAGUCCA-3' | (SEQ ID NO: 1190) |
| AAT-475 19 nt Target #2: | 5'-CCAGCUGGCACACCAGUCC-3' | (SEQ ID NO: 1388) |
| AAT-475 19 nt Target #3: | 5'-GCCAGCUGGCACACCAGUC-3' | (SEQ ID NO: 1586) |
| AAT-477 19 nt Target #1: | 5'-GCUGGCACACCAGUCCAAC-3' | (SEQ ID NO: 1191) |
| AAT-477 19 nt Target #2: | 5'-AGCUGGCACACCAGUCCAA-3' | (SEQ ID NO: 1389) |
| AAT-477 19 nt Target #3: | 5'-CAGCUGGCACACCAGUCCA-3' | (SEQ ID NO: 1587) |
| AAT-480 19 nt Target #1: | 5'-GGCACACCAGUCCAACAGC-3' | (SEQ ID NO: 1192) |
| AAT-480 19 nt Target #2: | 5'-UGGCACACCAGUCCAACAG-3' | (SEQ ID NO: 1390) |
| AAT-480 19 nt Target #3: | 5'-CUGGCACACCAGUCCAACA-3' | (SEQ ID NO: 1588) |
| AAT-481 19 nt Target #1: | 5'-GCACACCAGUCCAACAGCA-3' | (SEQ ID NO: 1193) |
| AAT-481 19 nt Target #2: | 5'-GGCACACCAGUCCAACAGC-3' | (SEQ ID NO: 1391) |
| AAT-481 19 nt Target #3: | 5'-UGGCACACCAGUCCAACAG-3' | (SEQ ID NO: 1589) |
| AAT-482 19 nt Target #1: | 5'-CACACCAGUCCAACAGCAC-3' | (SEQ ID NO: 1194) |
| AAT-482 19 nt Target #2: | 5'-GCACACCAGUCCAACAGCA-3' | (SEQ ID NO: 1392) |
| AAT-482 19 nt Target #3: | 5'-GGCACACCAGUCCAACAGC-3' | (SEQ ID NO: 1590) |
| AAT-483 19 nt Target #1: | 5'-ACACCAGUCCAACAGCACC-3' | (SEQ ID NO: 1195) |
| AAT-483 19 nt Target #2: | 5'-CACACCAGUCCAACAGCAC-3' | (SEQ ID NO: 1393) |
| AAT-483 19 nt Target #3: | 5'-GCACACCAGUCCAACAGCA-3' | (SEQ ID NO: 1591) |
| AAT-484 19 nt Target #1: | 5'-CACCAGUCCAACAGCACCA-3' | (SEQ ID NO: 1196) |
| AAT-484 19 nt Target #2: | 5'-ACACCAGUCCAACAGCACC-3' | (SEQ ID NO: 1394) |
| AAT-484 19 nt Target #3: | 5'-CACACCAGUCCAACAGCAC-3' | (SEQ ID NO: 1592) |
| AAT-500 19 nt Target #1: | 5'-CCAAUAUCUUCUUCUCCCC-3' | (SEQ ID NO: 1197) |
| AAT-500 19 nt Target #2: | 5'-ACCAAUAUCUUCUUCUCCC-3' | (SEQ ID NO: 1395) |
| AAT-500 19 nt Target #3: | 5'-CACCAAUAUCUUCUUCUCC-3' | (SEQ ID NO: 1593) |
| AAT-501 19 nt Target #1: | 5'-CAAUAUCUUCUUCUCCCCA-3' | (SEQ ID NO: 1198) |
| AAT-501 19 nt Target #2: | 5'-CCAAUAUCUUCUUCUCCCC-3' | (SEQ ID NO: 1396) |
| AAT-501 19 nt Target #3: | 5'-ACCAAUAUCUUCUUCUCCC-3' | (SEQ ID NO: 1594) |
| AAT-502 19 nt Target #1: | 5'-AAUAUCUUCUUCUCCCCAG-3' | (SEQ ID NO: 1199) |
| AAT-502 19 nt Target #2: | 5'-CAAUAUCUUCUUCUCCCCA-3' | (SEQ ID NO: 1397) |
| AAT-502 19 nt Target #3: | 5'-CCAAUAUCUUCUUCUCCCC-3' | (SEQ ID NO: 1595) |
| AAT-503 19 nt Target #1: | 5'-AUAUCUUCUUCUCCCCAGU-3' | (SEQ ID NO: 1200) |
| AAT-503 19 nt Target #2: | 5'-AAUAUCUUCUUCUCCCCAG-3' | (SEQ ID NO: 1398) |
| AAT-503 19 nt Target #3: | 5'-CAAUAUCUUCUUCUCCCCA-3' | (SEQ ID NO: 1596) |
| AAT-504 19 nt Target #1: | 5'-UAUCUUCUUCUCCCCAGUG-3' | (SEQ ID NO: 1201) |
| AAT-504 19 nt Target #2: | 5'-AUAUCUUCUUCUCCCCAGU-3' | (SEQ ID NO: 1399) |
| AAT-504 19 nt Target #3: | 5'-AAUAUCUUCUUCUCCCCAG-3' | (SEQ ID NO: 1597) |

TABLE 6-continued

DsiRNA Component 19 Nucleotide Target Sequences in α-1 antitrypsin mRNA

| | | | |
|---|---|---|---|
| AAT-505 19 nt Target #1: | 5'-AUCUUCUUCUCCCCAGUGA-3' | (SEQ ID NO: 1202) |
| AAT-505 19 nt Target #2: | 5'-UAUCUUCUUCUCCCCAGUG-3' | (SEQ ID NO: 1400) |
| AAT-505 19 nt Target #3: | 5'-AUAUCUUCUUCUCCCCAGU-3' | (SEQ ID NO: 1598) |
| AAT-506 19 nt Target #1: | 5'-UCUUCUUCUCCCCAGUGAG-3' | (SEQ ID NO: 1203) |
| AAT-506 19 nt Target #2: | 5'-AUCUUCUUCUCCCCAGUGA-3' | (SEQ ID NO: 1401) |
| AAT-506 19 nt Target #3: | 5'-UAUCUUCUUCUCCCCAGUG-3' | (SEQ ID NO: 1599) |
| AAT-507 19 nt Target #1: | 5'-CUUCUUCUCCCCAGUGAGC-3' | (SEQ ID NO: 1204) |
| AAT-507 19 nt Target #2: | 5'-UCUUCUUCUCCCCAGUGAG-3' | (SEQ ID NO: 1402) |
| AAT-507 19 nt Target #3: | 5'-AUCUUCUUCUCCCCAGUGA-3' | (SEQ ID NO: 1600) |
| AAT-508 19 nt Target #1: | 5'-UUCUUCUCCCCAGUGAGCA-3' | (SEQ ID NO: 1205) |
| AAT-508 19 nt Target #2: | 5'-CUUCUUCUCCCCAGUGAGC-3' | (SEQ ID NO: 1403) |
| AAT-508 19 nt Target #3: | 5'-UCUUCUUCUCCCCAGUGAG-3' | (SEQ ID NO: 1601) |
| AAT-509 19 nt Target #1: | 5'-UCUUCUCCCCAGUGAGCAU-3' | (SEQ ID NO: 1206) |
| AAT-509 19 nt Target #2: | 5'-UUCUUCUCCCCAGUGAGCA-3' | (SEQ ID NO: 1404) |
| AAT-509 19 nt Target #3: | 5'-CUUCUUCUCCCCAGUGAGC-3' | (SEQ ID NO: 1602) |
| AAT-510 19 nt Target #1: | 5'-CUUCUCCCCAGUGAGCAUC-3' | (SEQ ID NO: 1207) |
| AAT-510 19 nt Target #2: | 5'-UCUUCUCCCCAGUGAGCAU-3' | (SEQ ID NO: 1405) |
| AAT-510 19 nt Target #3: | 5'-UUCUUCUCCCCAGUGAGCA-3' | (SEQ ID NO: 1603) |
| AAT-512 19 nt Target #1: | 5'-UCUCCCCAGUGAGCAUCGC-3' | (SEQ ID NO: 1208) |
| AAT-512 19 nt Target #2: | 5'-UUCUCCCCAGUGAGCAUCG-3' | (SEQ ID NO: 1406) |
| AAT-512 19 nt Target #3: | 5'-CUUCUCCCCAGUGAGCAUC-3' | (SEQ ID NO: 1604) |
| AAT-513 19 nt Target #1: | 5'-CUCCCCAGUGAGCAUCGCU-3' | (SEQ ID NO: 1209) |
| AAT-513 19 nt Target #2: | 5'-UCUCCCCAGUGAGCAUCGC-3' | (SEQ ID NO: 1407) |
| AAT-513 19 nt Target #3: | 5'-UUCUCCCCAGUGAGCAUCG-3' | (SEQ ID NO: 1605) |
| AAT-515 19 nt Target #1: | 5'-CCCCAGUGAGCAUCGCUAC-3' | (SEQ ID NO: 1210) |
| AAT-515 19 nt Target #2: | 5'-UCCCCAGUGAGCAUCGCUA-3' | (SEQ ID NO: 1408) |
| AAT-515 19 nt Target #3: | 5'-CUCCCCAGUGAGCAUCGCU-3' | (SEQ ID NO: 1606) |
| AAT-532 19 nt Target #1: | 5'-ACAGCCUUUGCAAUGCUCU-3' | (SEQ ID NO: 1211) |
| AAT-532 19 nt Target #2: | 5'-UACAGCCUUUGCAAUGCUC-3' | (SEQ ID NO: 1409) |
| AAT-532 19 nt Target #3: | 5'-CUACAGCCUUUGCAAUGCU-3' | (SEQ ID NO: 1607) |
| AAT-540 19 nt Target #1: | 5'-UGCAAUGCUCUCCCUGGGG-3' | (SEQ ID NO: 1212) |
| AAT-540 19 nt Target #2: | 5'-UUGCAAUGCUCUCCCUGGG-3' | (SEQ ID NO: 1410) |
| AAT-540 19 nt Target #3: | 5'-UUUGCAAUGCUCUCCCUGG-3' | (SEQ ID NO: 1608) |
| AAT-581 19 nt Target #1: | 5'-AAAUCCUGGAGGGCCUGAA-3' | (SEQ ID NO: 1213) |
| AAT-581 19 nt Target #2: | 5'-GAAAUCCUGGAGGGCCUGA-3' | (SEQ ID NO: 1411) |
| AAT-581 19 nt Target #3: | 5'-UGAAAUCCUGGAGGGCCUG-3' | (SEQ ID NO: 1609) |
| AAT-582 19 nt Target #1: | 5'-AAUCCUGGAGGGCCUGAAU-3' | (SEQ ID NO: 1214) |
| AAT-582 19 nt Target #2: | 5'-AAAUCCUGGAGGGCCUGAA-3' | (SEQ ID NO: 1412) |

TABLE 6-continued

DsiRNA Component 19 Nucleotide Target
Sequences in α-1 antitrypsin mRNA

| | | |
|---|---|---|
| AAT-582 19 nt Target #3: | 5'-GAAAUCCUGGAGGGCCUGA-3' | (SEQ ID NO: 1610) |
| AAT-583 19 nt Target #1: | 5'-AUCCUGGAGGGCCUGAAUU-3' | (SEQ ID NO: 1215) |
| AAT-583 19 nt Target #2: | 5'-AAUCCUGGAGGGCCUGAAU-3' | (SEQ ID NO: 1413) |
| AAT-583 19 nt Target #3: | 5'-AAAUCCUGGAGGGCCUGAA-3' | (SEQ ID NO: 1611) |
| AAT-585 19 nt Target #1: | 5'-CCUGGAGGGCCUGAAUUUC-3' | (SEQ ID NO: 1216) |
| AAT-585 19 nt Target #2: | 5'-UCCUGGAGGGCCUGAAUUU-3' | (SEQ ID NO: 1414) |
| AAT-585 19 nt Target #3: | 5'-AUCCUGGAGGGCCUGAAUU-3' | (SEQ ID NO: 1612) |
| AAT-586 19 nt Target #1: | 5'-CUGGAGGGCCUGAAUUUCA-3' | (SEQ ID NO: 1217) |
| AAT-586 19 nt Target #2: | 5'-CCUGGAGGGCCUGAAUUUC-3' | (SEQ ID NO: 1415) |
| AAT-586 19 nt Target #3: | 5'-UCCUGGAGGGCCUGAAUUU-3' | (SEQ ID NO: 1613) |
| AAT-587 19 nt Target #1: | 5'-UGGAGGGCCUGAAUUUCAA-3' | (SEQ ID NO: 1218) |
| AAT-587 19 nt Target #2: | 5'-CUGGAGGGCCUGAAUUUCA-3' | (SEQ ID NO: 1416) |
| AAT-587 19 nt Target #3: | 5'-CCUGGAGGGCCUGAAUUUC-3' | (SEQ ID NO: 1614) |
| AAT-634 19 nt Target #1: | 5'-CAUGAAGGCUUCCAGGAAC-3' | (SEQ ID NO: 1219) |
| AAT-634 19 nt Target #2: | 5'-CCAUGAAGGCUUCCAGGAA-3' | (SEQ ID NO: 1417) |
| AAT-634 19 nt Target #3: | 5'-UCCAUGAAGGCUUCCAGGA-3' | (SEQ ID NO: 1615) |
| AAT-637 19 nt Target #1: | 5'-GAAGGCUUCCAGGAACUCC-3' | (SEQ ID NO: 1220) |
| AAT-637 19 nt Target #2: | 5'-UGAAGGCUUCCAGGAACUC-3' | (SEQ ID NO: 1418) |
| AAT-637 19 nt Target #3: | 5'-AUGAAGGCUUCCAGGAACU-3' | (SEQ ID NO: 1616) |
| AAT-638 19 nt Target #1: | 5'-AAGGCUUCCAGGAACUCCU-3' | (SEQ ID NO: 1221) |
| AAT-638 19 nt Target #2: | 5'-GAAGGCUUCCAGGAACUCC-3' | (SEQ ID NO: 1419) |
| AAT-638 19 nt Target #3: | 5'-UGAAGGCUUCCAGGAACUC-3' | (SEQ ID NO: 1617) |
| AAT-671 19 nt Target #1: | 5'-AGCCAGACAGCCAGCUCCA-3' | (SEQ ID NO: 1222) |
| AAT-671 19 nt Target #2: | 5'-CAGCCAGACAGCCAGCUCC-3' | (SEQ ID NO: 1420) |
| AAT-671 19 nt Target #3: | 5'-CCAGCCAGACAGCCAGCUC-3' | (SEQ ID NO: 1618) |
| AAT-673 19 nt Target #1: | 5'-CCAGACAGCCAGCUCCAGC-3' | (SEQ ID NO: 1223) |
| AAT-673 19 nt Target #2: | 5'-GCCAGACAGCCAGCUCCAG-3' | (SEQ ID NO: 1421) |
| AAT-673 19 nt Target #3: | 5'-AGCCAGACAGCCAGCUCCA-3' | (SEQ ID NO: 1619) |
| AAT-675 19 nt Target #1: | 5'-AGACAGCCAGCUCCAGCUG-3' | (SEQ ID NO: 1224) |
| AAT-675 19 nt Target #2: | 5'-CAGACAGCCAGCUCCAGCU-3' | (SEQ ID NO: 1422) |
| AAT-675 19 nt Target #3: | 5'-CCAGACAGCCAGCUCCAGC-3' | (SEQ ID NO: 1620) |
| AAT-676 19 nt Target #1: | 5'-GACAGCCAGCUCCAGCUGA-3' | (SEQ ID NO: 1225) |
| AAT-676 19 nt Target #2: | 5'-AGACAGCCAGCUCCAGCUG-3' | (SEQ ID NO: 1423) |
| AAT-676 19 nt Target #3: | 5'-CAGACAGCCAGCUCCAGCU-3' | (SEQ ID NO: 1621) |
| AAT-734 19 nt Target #1: | 5'-UAGUGGAUAAGUUUUUGGA-3' | (SEQ ID NO: 1226) |
| AAT-734 19 nt Target #2: | 5'-CUAGUGGAUAAGUUUUUGG-3' | (SEQ ID NO: 1424) |
| AAT-734 19 nt Target #3: | 5'-GCUAGUGGAUAAGUUUUUG-3' | (SEQ ID NO: 1622) |
| AAT-735 19 nt Target #1: | 5'-AGUGGAUAAGUUUUUGGAG-3' | (SEQ ID NO: 1227) |
| AAT-735 19 nt Target #2: | 5'-UAGUGGAUAAGUUUUUGGA-3' | (SEQ ID NO: 1425) |

TABLE 6-continued

DsiRNA Component 19 Nucleotide Target
Sequences in α-1 antitrypsin mRNA

| | | |
|---|---|---|
| AAT-735 19 nt Target #3: | 5'-CUAGUGGAUAAGUUUUUGG-3' | (SEQ ID NO: 1623) |
| AAT-736 19 nt Target #1: | 5'-GUGGAUAAGUUUUUGGAGG-3' | (SEQ ID NO: 1228) |
| AAT-736 19 nt Target #2: | 5'-AGUGGAUAAGUUUUUGGAG-3' | (SEQ ID NO: 1426) |
| AAT-736 19 nt Target #3: | 5'-UAGUGGAUAAGUUUUUGGA-3' | (SEQ ID NO: 1624) |
| AAT-737 19 nt Target #1: | 5'-UGGAUAAGUUUUUGGAGGA-3' | (SEQ ID NO: 1229) |
| AAT-737 19 nt Target #2: | 5'-GUGGAUAAGUUUUUGGAGG-3' | (SEQ ID NO: 1427) |
| AAT-737 19 nt Target #3: | 5'-AGUGGAUAAGUUUUUGGAG-3' | (SEQ ID NO: 1625) |
| AAT-738 19 nt Target #1: | 5'-GGAUAAGUUUUUGGAGGAU-3' | (SEQ ID NO: 1230) |
| AAT-738 19 nt Target #2: | 5'-UGGAUAAGUUUUUGGAGGA-3' | (SEQ ID NO: 1428) |
| AAT-738 19 nt Target #3: | 5'-GUGGAUAAGUUUUUGGAGG-3' | (SEQ ID NO: 1626) |
| AAT-739 19 nt Target #1: | 5'-GAUAAGUUUUUGGAGGAUG-3' | (SEQ ID NO: 1231) |
| AAT-739 19 nt Target #2: | 5'-GGAUAAGUUUUUGGAGGAU-3' | (SEQ ID NO: 1429) |
| AAT-739 19 nt Target #3: | 5'-UGGAUAAGUUUUUGGAGGA-3' | (SEQ ID NO: 1627) |
| AAT-740 19 nt Target #1: | 5'-AUAAGUUUUUGGAGGAUGU-3' | (SEQ ID NO: 1232) |
| AAT-740 19 nt Target #2: | 5'-GAUAAGUUUUUGGAGGAUG-3' | (SEQ ID NO: 1430) |
| AAT-740 19 nt Target #3: | 5'-GGAUAAGUUUUUGGAGGAU-3' | (SEQ ID NO: 1628) |
| AAT-767 19 nt Target #1: | 5'-UGUACCACUCAGAAGCCUU-3' | (SEQ ID NO: 1233) |
| AAT-767 19 nt Target #2: | 5'-UUGUACCACUCAGAAGCCU-3' | (SEQ ID NO: 1431) |
| AAT-767 19 nt Target #3: | 5'-GUUGUACCACUCAGAAGCC-3' | (SEQ ID NO: 1629) |
| AAT-768 19 nt Target #1: | 5'-GUACCACUCAGAAGCCUUC-3' | (SEQ ID NO: 1234) |
| AAT-768 19 nt Target #2: | 5'-UGUACCACUCAGAAGCCUU-3' | (SEQ ID NO: 1432) |
| AAT-768 19 nt Target #3: | 5'-UUGUACCACUCAGAAGCCU-3' | (SEQ ID NO: 1630) |
| AAT-850 19 nt Target #1: | 5'-ACUCAAGGGAAAAUUGUGG-3' | (SEQ ID NO: 1235) |
| AAT-850 19 nt Target #2: | 5'-UACUCAAGGGAAAAUUGUG-3' | (SEQ ID NO: 1433) |
| AAT-850 19 nt Target #3: | 5'-GUACUCAAGGGAAAAUUGU-3' | (SEQ ID NO: 1631) |
| AAT-851 19 nt Target #1: | 5'-CUCAAGGGAAAAUUGUGGA-3' | (SEQ ID NO: 1236) |
| AAT-851 19 nt Target #2: | 5'-ACUCAAGGGAAAAUUGUGG-3' | (SEQ ID NO: 1434) |
| AAT-851 19 nt Target #3: | 5'-UACUCAAGGGAAAAUUGUG-3' | (SEQ ID NO: 1632) |
| AAT-852 19 nt Target #1: | 5'-UCAAGGGAAAAUUGUGGAU-3' | (SEQ ID NO: 1237) |
| AAT-852 19 nt Target #2: | 5'-CUCAAGGGAAAAUUGUGGA-3' | (SEQ ID NO: 1435) |
| AAT-852 19 nt Target #3: | 5'-ACUCAAGGGAAAAUUGUGG-3' | (SEQ ID NO: 1633) |
| AAT-853 19 nt Target #1: | 5'-CAAGGGAAAAUUGUGGAUU-3' | (SEQ ID NO: 1238) |
| AAT-853 19 nt Target #2: | 5'-UCAAGGGAAAAUUGUGGAU-3' | (SEQ ID NO: 1436) |
| AAT-853 19 nt Target #3: | 5'-CUCAAGGGAAAAUUGUGGA-3' | (SEQ ID NO: 1634) |
| AAT-854 19 nt Target #1: | 5'-AAGGGAAAAUUGUGGAUUU-3' | (SEQ ID NO: 1239) |
| AAT-854 19 nt Target #2: | 5'-CAAGGGAAAAUUGUGGAUU-3' | (SEQ ID NO: 1437) |
| AAT-854 19 nt Target #3: | 5'-UCAAGGGAAAAUUGUGGAU-3' | (SEQ ID NO: 1635) |
| AAT-855 19 nt Target #1: | 5'-AGGGAAAAUUGUGGAUUUG-3' | (SEQ ID NO: 1240) |

TABLE 6-continued

DsiRNA Component 19 Nucleotide Target
Sequences in α-1 antitrypsin mRNA

AAT-855 19 nt Target #2:  5'-AAGGGAAAAUUGUGGAUUU-3'  (SEQ ID NO: 1438)

AAT-855 19 nt Target #3:  5'-CAAGGGAAAAUUGUGGAUU-3'  (SEQ ID NO: 1636)

AAT-856 19 nt Target #1:  5'-GGGAAAAUUGUGGAUUUGG-3'  (SEQ ID NO: 1241)

AAT-856 19 nt Target #2:  5'-AGGGAAAAUUGUGGAUUUG-3'  (SEQ ID NO: 1439)

AAT-856 19 nt Target #3:  5'-AAGGGAAAAUUGUGGAUUU-3'  (SEQ ID NO: 1637)

AAT-857 19 nt Target #1:  5'-GGAAAAUUGUGGAUUUGGU-3'  (SEQ ID NO: 1242)

AAT-857 19 nt Target #2:  5'-GGGAAAAUUGUGGAUUUGG-3'  (SEQ ID NO: 1440)

AAT-857 19 nt Target #3:  5'-AGGGAAAAUUGUGGAUUUG-3'  (SEQ ID NO: 1638)

AAT-858 19 nt Target #1:  5'-GAAAAUUGUGGAUUUGGUC-3'  (SEQ ID NO: 1243)

AAT-858 19 nt Target #2:  5'-GGAAAAUUGUGGAUUUGGU-3'  (SEQ ID NO: 1441)

AAT-858 19 nt Target #3:  5'-GGGAAAAUUGUGGAUUUGG-3'  (SEQ ID NO: 1639)

AAT-859 19 nt Target #1:  5'-AAAAUUGUGGAUUUGGUCA-3'  (SEQ ID NO: 1244)

AAT-859 19 nt Target #2:  5'-GAAAAUUGUGGAUUUGGUC-3'  (SEQ ID NO: 1442)

AAT-859 19 nt Target #3:  5'-GGAAAAUUGUGGAUUUGGU-3'  (SEQ ID NO: 1640)

AAT-860 19 nt Target #1:  5'-AAAUUGUGGAUUUGGUCAA-3'  (SEQ ID NO: 1245)

AAT-860 19 nt Target #2:  5'-AAAAUUGUGGAUUUGGUCA-3'  (SEQ ID NO: 1443)

AAT-860 19 nt Target #3:  5'-GAAAAUUGUGGAUUUGGUC-3'  (SEQ ID NO: 1641)

AAT-861 19 nt Target #1:  5'-AAUUGUGGAUUUGGUCAAG-3'  (SEQ ID NO: 1246)

AAT-861 19 nt Target #2:  5'-AAAUUGUGGAUUUGGUCAA-3'  (SEQ ID NO: 1444)

AAT-861 19 nt Target #3:  5'-AAAAUUGUGGAUUUGGUCA-3'  (SEQ ID NO: 1642)

AAT-862 19 nt Target #1:  5'-AUUGUGGAUUUGGUCAAGG-3'  (SEQ ID NO: 1247)

AAT-862 19 nt Target #2:  5'-AAUUGUGGAUUUGGUCAAG-3'  (SEQ ID NO: 1445)

AAT-862 19 nt Target #3:  5'-AAAUUGUGGAUUUGGUCAA-3'  (SEQ ID NO: 1643)

AAT-863 19 nt Target #1:  5'-UUGUGGAUUUGGUCAAGGA-3'  (SEQ ID NO: 1248)

AAT-863 19 nt Target #2:  5'-AUUGUGGAUUUGGUCAAGG-3'  (SEQ ID NO: 1446)

AAT-863 19 nt Target #3:  5'-AAUUGUGGAUUUGGUCAAG-3'  (SEQ ID NO: 1644)

AAT-864 19 nt Target #1:  5'-UGUGGAUUUGGUCAAGGAG-3'  (SEQ ID NO: 1249)

AAT-864 19 nt Target #2:  5'-UUGUGGAUUUGGUCAAGGA-3'  (SEQ ID NO: 1447)

AAT-864 19 nt Target #3:  5'-AUUGUGGAUUUGGUCAAGG-3'  (SEQ ID NO: 1645)

AAT-865 19 nt Target #1:  5'-GUGGAUUUGGUCAAGGAGC-3'  (SEQ ID NO: 1250)

AAT-865 19 nt Target #2:  5'-UGUGGAUUUGGUCAAGGAG-3'  (SEQ ID NO: 1448)

AAT-865 19 nt Target #3:  5'-UUGUGGAUUUGGUCAAGGA-3'  (SEQ ID NO: 1646)

AAT-866 19 nt Target #1:  5'-UGGAUUUGGUCAAGGAGCU-3'  (SEQ ID NO: 1251)

AAT-866 19 nt Target #2:  5'-GUGGAUUUGGUCAAGGAGC-3'  (SEQ ID NO: 1449)

AAT-866 19 nt Target #3:  5'-UGUGGAUUUGGUCAAGGAG-3'  (SEQ ID NO: 1647)

AAT-867 19 nt Target #1:  5'-GGAUUUGGUCAAGGAGCUU-3'  (SEQ ID NO: 1252)

AAT-867 19 nt Target #2:  5'-UGGAUUUGGUCAAGGAGCU-3'  (SEQ ID NO: 1450)

AAT-867 19 nt Target #3:  5'-GUGGAUUUGGUCAAGGAGC-3'  (SEQ ID NO: 1648)

AAT-868 19 nt Target #1:  5'-GAUUUGGUCAAGGAGCUUG-3'  (SEQ ID NO: 1253)

TABLE 6-continued

DsiRNA Component 19 Nucleotide Target
Sequences in α-1 antitrypsin mRNA

```
AAT-868 19 nt Target #2:   5'-GGAUUUGGUCAAGGAGCUU-3'   (SEQ ID NO: 1451)

AAT-868 19 nt Target #3:   5'-UGGAUUUGGUCAAGGAGCU-3'   (SEQ ID NO: 1649)

AAT-869 19 nt Target #1:   5'-AUUUGGUCAAGGAGCUUGA-3'   (SEQ ID NO: 1254)

AAT-869 19 nt Target #2:   5'-GAUUUGGUCAAGGAGCUUG-3'   (SEQ ID NO: 1452)

AAT-869 19 nt Target #3:   5'-GGAUUUGGUCAAGGAGCUU-3'   (SEQ ID NO: 1650)

AAT-870 19 nt Target #1:   5'-UUUGGUCAAGGAGCUUGAC-3'   (SEQ ID NO: 1255)

AAT-870 19 nt Target #2:   5'-AUUUGGUCAAGGAGCUUGA-3'   (SEQ ID NO: 1453)

AAT-870 19 nt Target #3:   5'-GAUUUGGUCAAGGAGCUUG-3'   (SEQ ID NO: 1651)

AAT-871 19 nt Target #1:   5'-UUGGUCAAGGAGCUUGACA-3'   (SEQ ID NO: 1256)

AAT-871 19 nt Target #2:   5'-UUUGGUCAAGGAGCUUGAC-3'   (SEQ ID NO: 1454)

AAT-871 19 nt Target #3:   5'-AUUUGGUCAAGGAGCUUGA-3'   (SEQ ID NO: 1652)

AAT-872 19 nt Target #1:   5'-UGGUCAAGGAGCUUGACAG-3'   (SEQ ID NO: 1257)

AAT-872 19 nt Target #2:   5'-UUGGUCAAGGAGCUUGACA-3'   (SEQ ID NO: 1455)

AAT-872 19 nt Target #3:   5'-UUUGGUCAAGGAGCUUGAC-3'   (SEQ ID NO: 1653)

AAT-896 19 nt Target #1:   5'-CAGUUUUGCUCUGGUGAA-3'    (SEQ ID NO: 1258)

AAT-896 19 nt Target #2:   5'-ACAGUUUUGCUCUGGUGA-3'    (SEQ ID NO: 1456)

AAT-896 19 nt Target #3:   5'-CACAGUUUUGCUCUGGUG-3'    (SEQ ID NO: 1654)

AAT-897 19 nt Target #1:   5'-AGUUUUGCUCUGGUGAAU-3'    (SEQ ID NO: 1259)

AAT-897 19 nt Target #2:   5'-CAGUUUUGCUCUGGUGAA-3'    (SEQ ID NO: 1457)

AAT-897 19 nt Target #3:   5'-ACAGUUUUGCUCUGGUGA-3'    (SEQ ID NO: 1655)

AAT-898 19 nt Target #1:   5'-GUUUUGCUCUGGUGAAUU-3'    (SEQ ID NO: 1260)

AAT-898 19 nt Target #2:   5'-AGUUUUGCUCUGGUGAAU-3'    (SEQ ID NO: 1458)

AAT-898 19 nt Target #3:   5'-CAGUUUUGCUCUGGUGAA-3'    (SEQ ID NO: 1656)

AAT-899 19 nt Target #1:   5'-UUUUUGCUCUGGUGAAUUA-3'   (SEQ ID NO: 1261)

AAT-899 19 nt Target #2:   5'-GUUUUGCUCUGGUGAAUU-3'    (SEQ ID NO: 1459)

AAT-899 19 nt Target #3:   5'-AGUUUUGCUCUGGUGAAU-3'    (SEQ ID NO: 1657)

AAT-928 19 nt Target #1:   5'-AAAGGCAAAUGGGAGAGAC-3'   (SEQ ID NO: 1262)

AAT-928 19 nt Target #2:   5'-UAAAGGCAAAUGGGAGAGA-3'   (SEQ ID NO: 1460)

AAT-928 19 nt Target #3:   5'-UUAAAGGCAAAUGGGAGAG-3'   (SEQ ID NO: 1658)

AAT-929 19 nt Target #1:   5'-AAGGCAAAUGGGAGAGACC-3'   (SEQ ID NO: 1263)

AAT-929 19 nt Target #2:   5'-AAAGGCAAAUGGGAGAGAC-3'   (SEQ ID NO: 1461)

AAT-929 19 nt Target #3:   5'-UAAAGGCAAAUGGGAGAGA-3'   (SEQ ID NO: 1659)

AAT-930 19 nt Target #1:   5'-AGGCAAAUGGGAGAGACCC-3'   (SEQ ID NO: 1264)

AAT-930 19 nt Target #2:   5'-AAGGCAAAUGGGAGAGACC-3'   (SEQ ID NO: 1462)

AAT-930 19 nt Target #3:   5'-AAAGGCAAAUGGGAGAGAC-3'   (SEQ ID NO: 1660)

AAT-931 19 nt Target #1:   5'-GGCAAAUGGGAGAGACCCU-3'   (SEQ ID NO: 1265)

AAT-931 19 nt Target #2:   5'-AGGCAAAUGGGAGAGACCC-3'   (SEQ ID NO: 1463)

AAT-931 19 nt Target #3:   5'-AAGGCAAAUGGGAGAGACC-3'   (SEQ ID NO: 1661)
```

TABLE 6-continued

DsiRNA Component 19 Nucleotide Target
Sequences in α-1 antitrypsin mRNA

| | | | |
|---|---|---|---|
| AAT-968 19 nt Target #1: | 5'-AGGAAGAGGACUUCCACGU-3' | (SEQ ID NO: 1266) |
| AAT-968 19 nt Target #2: | 5'-GAGGAAGAGGACUUCCACG-3' | (SEQ ID NO: 1464) |
| AAT-968 19 nt Target #3: | 5'-CGAGGAAGAGGACUUCCAC-3' | (SEQ ID NO: 1662) |
| AAT-969 19 nt Target #1: | 5'-GGAAGAGGACUUCCACGUG-3' | (SEQ ID NO: 1267) |
| AAT-969 19 nt Target #2: | 5'-AGGAAGAGGACUUCCACGU-3' | (SEQ ID NO: 1465) |
| AAT-969 19 nt Target #3: | 5'-GAGGAAGAGGACUUCCACG-3' | (SEQ ID NO: 1663) |
| AAT-970 19 nt Target #1: | 5'-GAAGAGGACUUCCACGUGG-3' | (SEQ ID NO: 1268) |
| AAT-970 19 nt Target #2: | 5'-GGAAGAGGACUUCCACGUG-3' | (SEQ ID NO: 1466) |
| AAT-970 19 nt Target #3: | 5'-AGGAAGAGGACUUCCACGU-3' | (SEQ ID NO: 1664) |
| AAT-971 19 nt Target #1: | 5'-AAGAGGACUUCCACGUGGA-3' | (SEQ ID NO: 1269) |
| AAT-971 19 nt Target #2: | 5'-GAAGAGGACUUCCACGUGG-3' | (SEQ ID NO: 1467) |
| AAT-971 19 nt Target #3: | 5'-GGAAGAGGACUUCCACGUG-3' | (SEQ ID NO: 1665) |
| AAT-973 19 nt Target #1: | 5'-GAGGACUUCCACGUGGACC-3' | (SEQ ID NO: 1270) |
| AAT-973 19 nt Target #2: | 5'-AGAGGACUUCCACGUGGAC-3' | (SEQ ID NO: 1468) |
| AAT-973 19 nt Target #3: | 5'-AAGAGGACUUCCACGUGGA-3' | (SEQ ID NO: 1666) |
| AAT-974 19 nt Target #1: | 5'-AGGACUUCCACGUGGACCA-3' | (SEQ ID NO: 1271) |
| AAT-974 19 nt Target #2: | 5'-GAGGACUUCCACGUGGACC-3' | (SEQ ID NO: 1469) |
| AAT-974 19 nt Target #3: | 5'-AGAGGACUUCCACGUGGAC-3' | (SEQ ID NO: 1667) |
| AAT-976 19 nt Target #1: | 5'-GACUUCCACGUGGACCAGG-3' | (SEQ ID NO: 1272) |
| AAT-976 19 nt Target #2: | 5'-GGACUUCCACGUGGACCAG-3' | (SEQ ID NO: 1470) |
| AAT-976 19 nt Target #3: | 5'-AGGACUUCCACGUGGACCA-3' | (SEQ ID NO: 1668) |
| AAT-1025 19 nt Target #1: | 5'-GUUUAGGCAUGUUUAACAU-3' | (SEQ ID NO: 1273) |
| AAT-1025 19 nt Target #2: | 5'-CGUUUAGGCAUGUUUAACA-3' | (SEQ ID NO: 1471) |
| AAT-1025 19 nt Target #3: | 5'-GCGUUUAGGCAUGUUUAAC-3' | (SEQ ID NO: 1669) |
| AAT-1026 19 nt Target #1: | 5'-UUUAGGCAUGUUUAACAUC-3' | (SEQ ID NO: 1274) |
| AAT-1026 19 nt Target #2: | 5'-GUUUAGGCAUGUUUAACAU-3' | (SEQ ID NO: 1472) |
| AAT-1026 19 nt Target #3: | 5'-CGUUUAGGCAUGUUUAACA-3' | (SEQ ID NO: 1670) |
| AAT-1059 19 nt Target #1: | 5'-GCUGUCCAGCUGGGUGCUG-3' | (SEQ ID NO: 1275) |
| AAT-1059 19 nt Target #2: | 5'-AGCUGUCCAGCUGGGUGCU-3' | (SEQ ID NO: 1473) |
| AAT-1059 19 nt Target #3: | 5'-AAGCUGUCCAGCUGGGUGC-3' | (SEQ ID NO: 1671) |
| AAT-1060 19 nt Target #1: | 5'-CUGUCCAGCUGGGUGCUGC-3' | (SEQ ID NO: 1276) |
| AAT-1060 19 nt Target #2: | 5'-GCUGUCCAGCUGGGUGCUG-3' | (SEQ ID NO: 1474) |
| AAT-1060 19 nt Target #3: | 5'-AGCUGUCCAGCUGGGUGCU-3' | (SEQ ID NO: 1672) |
| AAT-1095 19 nt Target #1: | 5'-CAAUGCCACCGCCAUCUUC-3' | (SEQ ID NO: 1277) |
| AAT-1095 19 nt Target #2: | 5'-GCAAUGCCACCGCCAUCUU-3' | (SEQ ID NO: 1475) |
| AAT-1095 19 nt Target #3: | 5'-GGCAAUGCCACCGCCAUCU-3' | (SEQ ID NO: 1673) |
| AAT-1096 19 nt Target #1: | 5'-AAUGCCACCGCCAUCUUCU-3' | (SEQ ID NO: 1278) |
| AAT-1096 19 nt Target #2: | 5'-CAAUGCCACCGCCAUCUUC-3' | (SEQ ID NO: 1476) |
| AAT-1096 19 nt Target #3: | 5'-GCAAUGCCACCGCCAUCUU-3' | (SEQ ID NO: 1674) |

TABLE 6-continued

DsiRNA Component 19 Nucleotide Target
Sequences in α-1 antitrypsin mRNA

| | | | |
|---|---|---|---|
| AAT-1100 19 nt Target #1: | 5'-CCACCGCCAUCUUCUUCCU-3' | (SEQ ID NO: 1279) |
| AAT-1100 19 nt Target #2: | 5'-GCCACCGCCAUCUUCUUCC-3' | (SEQ ID NO: 1477) |
| AAT-1100 19 nt Target #3: | 5'-UGCCACCGCCAUCUUCUUC-3' | (SEQ ID NO: 1675) |
| AAT-1101 19 nt Target #1: | 5'-CACCGCCAUCUUCUUCCUG-3' | (SEQ ID NO: 1280) |
| AAT-1101 19 nt Target #2: | 5'-CCACCGCCAUCUUCUUCCU-3' | (SEQ ID NO: 1478) |
| AAT-1101 19 nt Target #3: | 5'-GCCACCGCCAUCUUCUUCC-3' | (SEQ ID NO: 1676) |
| AAT-1102 19 nt Target #1: | 5'-ACCGCCAUCUUCUUCCUGC-3' | (SEQ ID NO: 1281) |
| AAT-1102 19 nt Target #2: | 5'-CACCGCCAUCUUCUUCCUG-3' | (SEQ ID NO: 1479) |
| AAT-1102 19 nt Target #3: | 5'-CCACCGCCAUCUUCUUCCU-3' | (SEQ ID NO: 1677) |
| AAT-1103 19 nt Target #1: | 5'-CCGCCAUCUUCUUCCUGCC-3' | (SEQ ID NO: 1282) |
| AAT-1103 19 nt Target #2: | 5'-ACCGCCAUCUUCUUCCUGC-3' | (SEQ ID NO: 1480) |
| AAT-1103 19 nt Target #3: | 5'-CACCGCCAUCUUCUUCCUG-3' | (SEQ ID NO: 1678) |
| AAT-1104 19 nt Target #1: | 5'-CGCCAUCUUCUUCCUGCCU-3' | (SEQ ID NO: 1283) |
| AAT-1104 19 nt Target #2: | 5'-CCGCCAUCUUCUUCCUGCC-3' | (SEQ ID NO: 1481) |
| AAT-1104 19 nt Target #3: | 5'-ACCGCCAUCUUCUUCCUGC-3' | (SEQ ID NO: 1679) |
| AAT-1105 19 nt Target #1: | 5'-GCCAUCUUCUUCCUGCCUG-3' | (SEQ ID NO: 1284) |
| AAT-1105 19 nt Target #2: | 5'-CGCCAUCUUCUUCCUGCCU-3' | (SEQ ID NO: 1482) |
| AAT-1105 19 nt Target #3: | 5'-CCGCCAUCUUCUUCCUGCC-3' | (SEQ ID NO: 1680) |
| AAT-1108 19 nt Target #1: | 5'-AUCUUCUUCCUGCCUGAUG-3' | (SEQ ID NO: 1285) |
| AAT-1108 19 nt Target #2: | 5'-CAUCUUCUUCCUGCCUGAU-3' | (SEQ ID NO: 1483) |
| AAT-1108 19 nt Target #3: | 5'-CCAUCUUCUUCCUGCCUGA-3' | (SEQ ID NO: 1681) |
| AAT-1113 19 nt Target #1: | 5'-CUUCCUGCCUGAUGAGGGG-3' | (SEQ ID NO: 1286) |
| AAT-1113 19 nt Target #2: | 5'-UCUUCCUGCCUGAUGAGGG-3' | (SEQ ID NO: 1484) |
| AAT-1113 19 nt Target #3: | 5'-UUCUUCCUGCCUGAUGAGG-3' | (SEQ ID NO: 1682) |
| AAT-1114 19 nt Target #1: | 5'-UUCCUGCCUGAUGAGGGGA-3' | (SEQ ID NO: 1287) |
| AAT-1114 19 nt Target #2: | 5'-CUUCCUGCCUGAUGAGGGG-3' | (SEQ ID NO: 1485) |
| AAT-1114 19 nt Target #3: | 5'-UCUUCCUGCCUGAUGAGGG-3' | (SEQ ID NO: 1683) |
| AAT-1115 19 nt Target #1: | 5'-UCCUGCCUGAUGAGGGGAA-3' | (SEQ ID NO: 1288) |
| AAT-1115 19 nt Target #2: | 5'-UUCCUGCCUGAUGAGGGGA-3' | (SEQ ID NO: 1486) |
| AAT-1115 19 nt Target #3: | 5'-CUUCCUGCCUGAUGAGGGG-3' | (SEQ ID NO: 1684) |
| AAT-1116 19 nt Target #1: | 5'-CCUGCCUGAUGAGGGGAAA-3' | (SEQ ID NO: 1289) |
| AAT-1116 19 nt Target #2: | 5'-UCCUGCCUGAUGAGGGGAA-3' | (SEQ ID NO: 1487) |
| AAT-1116 19 nt Target #3: | 5'-UUCCUGCCUGAUGAGGGGA-3' | (SEQ ID NO: 1685) |
| AAT-1117 19 nt Target #1: | 5'-CUGCCUGAUGAGGGGAAAC-3' | (SEQ ID NO: 1290) |
| AAT-1117 19 nt Target #2: | 5'-CCUGCCUGAUGAGGGGAAA-3' | (SEQ ID NO: 1488) |
| AAT-1117 19 nt Target #3: | 5'-UCCUGCCUGAUGAGGGGAA-3' | (SEQ ID NO: 1686) |
| AAT-1118 19 nt Target #1: | 5'-UGCCUGAUGAGGGGAAACU-3' | (SEQ ID NO: 1291) |
| AAT-1118 19 nt Target #2: | 5'-CUGCCUGAUGAGGGGAAAC-3' | (SEQ ID NO: 1489) |

TABLE 6-continued

DsiRNA Component 19 Nucleotide Target
Sequences in α-1 antitrypsin mRNA

| | | |
|---|---|---|
| AAT-1118 19 nt Target #3: | 5'-CCUGCCUGAUGAGGGGAAA-3' | (SEQ ID NO: 1687) |
| AAT-1139 19 nt Target #1: | 5'-AGCACCUGGAAAAUGAACU-3' | (SEQ ID NO: 1292) |
| AAT-1139 19 nt Target #2: | 5'-CAGCACCUGGAAAAUGAAC-3' | (SEQ ID NO: 1490) |
| AAT-1139 19 nt Target #3: | 5'-ACAGCACCUGGAAAAUGAA-3' | (SEQ ID NO: 1688) |
| AAT-1140 19 nt Target #1: | 5'-GCACCUGGAAAAUGAACUC-3' | (SEQ ID NO: 1293) |
| AAT-1140 19 nt Target #2: | 5'-AGCACCUGGAAAAUGAACU-3' | (SEQ ID NO: 1491) |
| AAT-1140 19 nt Target #3: | 5'-CAGCACCUGGAAAAUGAAC-3' | (SEQ ID NO: 1689) |
| AAT-1141 19 nt Target #1: | 5'-CACCUGGAAAAUGAACUCA-3' | (SEQ ID NO: 1294) |
| AAT-1141 19 nt Target #2: | 5'-GCACCUGGAAAAUGAACUC-3' | (SEQ ID NO: 1492) |
| AAT-1141 19 nt Target #3: | 5'-AGCACCUGGAAAAUGAACU-3' | (SEQ ID NO: 1690) |
| AAT-1142 19 nt Target #1: | 5'-ACCUGGAAAAUGAACUCAC-3' | (SEQ ID NO: 1295) |
| AAT-1142 19 nt Target #2: | 5'-CACCUGGAAAAUGAACUCA-3' | (SEQ ID NO: 1493) |
| AAT-1142 19 nt Target #3: | 5'-GCACCUGGAAAAUGAACUC-3' | (SEQ ID NO: 1691) |
| AAT-1143 19 nt Target #1: | 5'-CCUGGAAAAUGAACUCACC-3' | (SEQ ID NO: 1296) |
| AAT-1143 19 nt Target #2: | 5'-ACCUGGAAAAUGAACUCAC-3' | (SEQ ID NO: 1494) |
| AAT-1143 19 nt Target #3: | 5'-CACCUGGAAAAUGAACUCA-3' | (SEQ ID NO: 1692) |
| AAT-1166 19 nt Target #1: | 5'-AUAUCAUCACCAAGUUCCU-3' | (SEQ ID NO: 1297) |
| AAT-1166 19 nt Target #2: | 5'-GAUAUCAUCACCAAGUUCC-3' | (SEQ ID NO: 1495) |
| AAT-1166 19 nt Target #3: | 5'-CGAUAUCAUCACCAAGUUC-3' | (SEQ ID NO: 1693) |
| AAT-1167 19 nt Target #1: | 5'-UAUCAUCACCAAGUUCCUG-3' | (SEQ ID NO: 1298) |
| AAT-1167 19 nt Target #2: | 5'-AUAUCAUCACCAAGUUCCU-3' | (SEQ ID NO: 1496) |
| AAT-1167 19 nt Target #3: | 5'-GAUAUCAUCACCAAGUUCC-3' | (SEQ ID NO: 1694) |
| AAT-1168 19 nt Target #1: | 5'-AUCAUCACCAAGUUCCUGG-3' | (SEQ ID NO: 1299) |
| AAT-1168 19 nt Target #2: | 5'-UAUCAUCACCAAGUUCCUG-3' | (SEQ ID NO: 1497) |
| AAT-1168 19 nt Target #3: | 5'-AUAUCAUCACCAAGUUCCU-3' | (SEQ ID NO: 1695) |
| AAT-1169 19 nt Target #1: | 5'-UCAUCACCAAGUUCCUGGA-3' | (SEQ ID NO: 1300) |
| AAT-1169 19 nt Target #2: | 5'-AUCAUCACCAAGUUCCUGG-3' | (SEQ ID NO: 1498) |
| AAT-1169 19 nt Target #3: | 5'-UAUCAUCACCAAGUUCCUG-3' | (SEQ ID NO: 1696) |
| AAT-1170 19 nt Target #1: | 5'-CAUCACCAAGUUCCUGGAA-3' | (SEQ ID NO: 1301) |
| AAT-1170 19 nt Target #2: | 5'-UCAUCACCAAGUUCCUGGA-3' | (SEQ ID NO: 1499) |
| AAT-1170 19 nt Target #3: | 5'-AUCAUCACCAAGUUCCUGG-3' | (SEQ ID NO: 1697) |
| AAT-1171 19 nt Target #1: | 5'-AUCACCAAGUUCCUGGAAA-3' | (SEQ ID NO: 1302) |
| AAT-1171 19 nt Target #2: | 5'-CAUCACCAAGUUCCUGGAA-3' | (SEQ ID NO: 1500) |
| AAT-1171 19 nt Target #3: | 5'-UCAUCACCAAGUUCCUGGA-3' | (SEQ ID NO: 1698) |
| AAT-1172 19 nt Target #1: | 5'-UCACCAAGUUCCUGGAAAA-3' | (SEQ ID NO: 1303) |
| AAT-1172 19 nt Target #2: | 5'-AUCACCAAGUUCCUGGAAA-3' | (SEQ ID NO: 1501) |
| AAT-1172 19 nt Target #3: | 5'-CAUCACCAAGUUCCUGGAA-3' | (SEQ ID NO: 1699) |
| AAT-1173 19 nt Target #1: | 5'-CACCAAGUUCCUGGAAAAU-3' | (SEQ ID NO: 1304) |
| AAT-1173 19 nt Target #2: | 5'-UCACCAAGUUCCUGGAAAA-3' | (SEQ ID NO: 1502) |

TABLE 6-continued

DsiRNA Component 19 Nucleotide Target
Sequences in α-1 antitrypsin mRNA

```
AAT-1173 19 nt Target #3:   5'-AUCACCAAGUUCCUGGAAA-3'   (SEQ ID NO: 1700)

AAT-1174 19 nt Target #1:   5'-ACCAAGUUCCUGGAAAAUG-3'   (SEQ ID NO: 1305)

AAT-1174 19 nt Target #2:   5'-CACCAAGUUCCUGGAAAAU-3'   (SEQ ID NO: 1503)

AAT-1174 19 nt Target #3:   5'-UCACCAAGUUCCUGGAAAA-3'   (SEQ ID NO: 1701)

AAT-1175 19 nt Target #1:   5'-CCAAGUUCCUGGAAAAUGA-3'   (SEQ ID NO: 1306)

AAT-1175 19 nt Target #2:   5'-ACCAAGUUCCUGGAAAAUG-3'   (SEQ ID NO: 1504)

AAT-1175 19 nt Target #3:   5'-CACCAAGUUCCUGGAAAAU-3'   (SEQ ID NO: 1702)

AAT-1286 19 nt Target #1:   5'-AGGUCUUCAGCAAUGGGC-3'    (SEQ ID NO: 1307)

AAT-1286 19 nt Target #2:   5'-AAGGUCUUCAGCAAUGGGG-3'   (SEQ ID NO: 1505)

AAT-1286 19 nt Target #3:   5'-UAAGGUCUUCAGCAAUGGG-3'   (SEQ ID NO: 1703)

AAT-1296 19 nt Target #1:   5'-CAAUGGGGCUGACCUCUCC-3'   (SEQ ID NO: 1308)

AAT-1296 19 nt Target #2:   5'-GCAAUGGGGCUGACCUCUC-3'   (SEQ ID NO: 1506)

AAT-1296 19 nt Target #3:   5'-AGCAAUGGGGCUGACCUCU-3'   (SEQ ID NO: 1704)

AAT-1297 19 nt Target #1:   5'-AAUGGGGCUGACCUCUCCG-3'   (SEQ ID NO: 1309)

AAT-1297 19 nt Target #2:   5'-CAAUGGGGCUGACCUCUCC-3'   (SEQ ID NO: 1507)

AAT-1297 19 nt Target #3:   5'-GCAAUGGGGCUGACCUCUC-3'   (SEQ ID NO: 1705)

AAT-1298 19 nt Target #1:   5'-AUGGGGCUGACCUCUCCGG-3'   (SEQ ID NO: 1310)

AAT-1298 19 nt Target #2:   5'-AAUGGGGCUGACCUCUCCG-3'   (SEQ ID NO: 1508)

AAT-1298 19 nt Target #3:   5'-CAAUGGGGCUGACCUCUCC-3'   (SEQ ID NO: 1706)

AAT-1324 19 nt Target #1:   5'-GAGGAGGCACCCCUGAAGC-3'   (SEQ ID NO: 1311)

AAT-1324 19 nt Target #2:   5'-AGAGGAGGCACCCCUGAAG-3'   (SEQ ID NO: 1509)

AAT-1324 19 nt Target #3:   5'-CAGAGGAGGCACCCCUGAA-3'   (SEQ ID NO: 1707)

AAT-1326 19 nt Target #1:   5'-GGAGGCACCCCUGAAGCUC-3'   (SEQ ID NO: 1312)

AAT-1326 19 nt Target #2:   5'-AGGAGGCACCCCUGAAGCU-3'   (SEQ ID NO: 1510)

AAT-1326 19 nt Target #3:   5'-GAGGAGGCACCCCUGAAGC-3'   (SEQ ID NO: 1708)

AAT-1336 19 nt Target #1:   5'-CUGAAGCUCUCCAAGGCCG-3'   (SEQ ID NO: 1313)

AAT-1336 19 nt Target #2:   5'-CCUGAAGCUCUCCAAGGCC-3'   (SEQ ID NO: 1511)

AAT-1336 19 nt Target #3:   5'-CCCUGAAGCUCUCCAAGGC-3'   (SEQ ID NO: 1709)

AAT-1353 19 nt Target #1:   5'-CGUGCAUAAGGCUGUGCUG-3'   (SEQ ID NO: 1314)

AAT-1353 19 nt Target #2:   5'-CCGUGCAUAAGGCUGUGCU-3'   (SEQ ID NO: 1512)

AAT-1353 19 nt Target #3:   5'-GCCGUGCAUAAGGCUGUGC-3'   (SEQ ID NO: 1710)

AAT-1354 19 nt Target #1:   5'-GUGCAUAAGGCUGUGCUGA-3'   (SEQ ID NO: 1315)

AAT-1354 19 nt Target #2:   5'-CGUGCAUAAGGCUGUGCUG-3'   (SEQ ID NO: 1513)

AAT-1354 19 nt Target #3:   5'-CCGUGCAUAAGGCUGUGCU-3'   (SEQ ID NO: 1711)

AAT-1355 19 nt Target #1:   5'-UGCAUAAGGCUGUGCUGAC-3'   (SEQ ID NO: 1316)

AAT-1355 19 nt Target #2:   5'-GUGCAUAAGGCUGUGCUGA-3'   (SEQ ID NO: 1514)

AAT-1355 19 nt Target #3:   5'-CGUGCAUAAGGCUGUGCUG-3'   (SEQ ID NO: 1712)

AAT-1356 19 nt Target #1:   5'-GCAUAAGGCUGUGCUGACC-3'   (SEQ ID NO: 1317)
```

TABLE 6-continued

DsiRNA Component 19 Nucleotide Target
Sequences in α-1 antitrypsin mRNA

| | | |
|---|---|---|
| AAT-1356 19 nt Target #2: | 5'-UGCAUAAGGCUGUGCUGAC-3' | (SEQ ID NO: 1515) |
| AAT-1356 19 nt Target #3: | 5'-GUGCAUAAGGCUGUGCUGA-3' | (SEQ ID NO: 1713) |
| AAT-1357 19 nt Target #1: | 5'-CAUAAGGCUGUGCUGACCA-3' | (SEQ ID NO: 1318) |
| AAT-1357 19 nt Target #2: | 5'-GCAUAAGGCUGUGCUGACC-3' | (SEQ ID NO: 1516) |
| AAT-1357 19 nt Target #3: | 5'-UGCAUAAGGCUGUGCUGAC-3' | (SEQ ID NO: 1714) |
| AAT-1358 19 nt Target #1: | 5'-AUAAGGCUGUGCUGACCAU-3' | (SEQ ID NO: 1319) |
| AAT-1358 19 nt Target #2: | 5'-CAUAAGGCUGUGCUGACCA-3' | (SEQ ID NO: 1517) |
| AAT-1358 19 nt Target #3: | 5'-GCAUAAGGCUGUGCUGACC-3' | (SEQ ID NO: 1715) |
| AAT-1359 19 nt Target #1: | 5'-UAAGGCUGUGCUGACCAUC-3' | (SEQ ID NO: 1320) |
| AAT-1359 19 nt Target #2: | 5'-AUAAGGCUGUGCUGACCAU-3' | (SEQ ID NO: 1518) |
| AAT-1359 19 nt Target #3: | 5'-CAUAAGGCUGUGCUGACCA-3' | (SEQ ID NO: 1716) |
| AAT-1360 19 nt Target #1: | 5'-AAGGCUGUGCUGACCAUCG-3' | (SEQ ID NO: 1321) |
| AAT-1360 19 nt Target #2: | 5'-UAAGGCUGUGCUGACCAUC-3' | (SEQ ID NO: 1519) |
| AAT-1360 19 nt Target #3: | 5'-AUAAGGCUGUGCUGACCAU-3' | (SEQ ID NO: 1717) |
| AAT-1361 19 nt Target #1: | 5'-AGGCUGUGCUGACCAUCGA-3' | (SEQ ID NO: 1322) |
| AAT-1361 19 nt Target #2: | 5'-AAGGCUGUGCUGACCAUCG-3' | (SEQ ID NO: 1520) |
| AAT-1361 19 nt Target #3: | 5'-UAAGGCUGUGCUGACCAUC-3' | (SEQ ID NO: 1718) |
| AAT-1390 19 nt Target #1: | 5'-ACUGAAGCUGCUGGGGCCA-3' | (SEQ ID NO: 1323) |
| AAT-1390 19 nt Target #2: | 5'-GACUGAAGCUGCUGGGGCC-3' | (SEQ ID NO: 1521) |
| AAT-1390 19 nt Target #3: | 5'-GGACUGAAGCUGCUGGGGC-3' | (SEQ ID NO: 1719) |
| AAT-1391 19 nt Target #1: | 5'-CUGAAGCUGCUGGGGCCAU-3' | (SEQ ID NO: 1324) |
| AAT-1391 19 nt Target #2: | 5'-ACUGAAGCUGCUGGGGCCA-3' | (SEQ ID NO: 1522) |
| AAT-1391 19 nt Target #3: | 5'-GACUGAAGCUGCUGGGGCC-3' | (SEQ ID NO: 1720) |
| AAT-1392 19 nt Target #1: | 5'-UGAAGCUGCUGGGGCCAUG-3' | (SEQ ID NO: 1325) |
| AAT-1392 19 nt Target #2: | 5'-CUGAAGCUGCUGGGGCCAU-3' | (SEQ ID NO: 1523) |
| AAT-1392 19 nt Target #3: | 5'-ACUGAAGCUGCUGGGGCCA-3' | (SEQ ID NO: 1721) |
| AAT-1393 19 nt Target #1: | 5'-GAAGCUGCUGGGGCCAUGU-3' | (SEQ ID NO: 1326) |
| AAT-1393 19 nt Target #2: | 5'-UGAAGCUGCUGGGGCCAUG-3' | (SEQ ID NO: 1524) |
| AAT-1393 19 nt Target #3: | 5'-CUGAAGCUGCUGGGGCCAU-3' | (SEQ ID NO: 1722) |
| AAT-1394 19 nt Target #1: | 5'-AAGCUGCUGGGGCCAUGUU-3' | (SEQ ID NO: 1327) |
| AAT-1394 19 nt Target #2: | 5'-GAAGCUGCUGGGGCCAUGU-3' | (SEQ ID NO: 1525) |
| AAT-1394 19 nt Target #3: | 5'-UGAAGCUGCUGGGGCCAUG-3' | (SEQ ID NO: 1723) |
| AAT-1395 19 nt Target #1: | 5'-AGCUGCUGGGGCCAUGUUU-3' | (SEQ ID NO: 1328) |
| AAT-1395 19 nt Target #2: | 5'-AAGCUGCUGGGGCCAUGUU-3' | (SEQ ID NO: 1526) |
| AAT-1395 19 nt Target #3: | 5'-GAAGCUGCUGGGGCCAUGU-3' | (SEQ ID NO: 1724) |
| AAT-1405 19 nt Target #1: | 5'-GCCAUGUUUUAGAGGCCA-3' | (SEQ ID NO: 1329) |
| AAT-1405 19 nt Target #2: | 5'-GGCCAUGUUUUAGAGGCC-3' | (SEQ ID NO: 1527) |
| AAT-1405 19 nt Target #3: | 5'-GGGCCAUGUUUUAGAGGC-3' | (SEQ ID NO: 1725) |
| AAT-1406 19 nt Target #1: | 5'-CCAUGUUUUAGAGGCCAU-3' | (SEQ ID NO: 1330) |

TABLE 6-continued

DsiRNA Component 19 Nucleotide Target
Sequences in α-1 antitrypsin mRNA

```
AAT-1406 19 nt Target #2:   5'-GCCAUGUUUUAGAGGCCA-3'     (SEQ ID NO: 1528)

AAT-1406 19 nt Target #3:   5'-GGCCAUGUUUUAGAGGCC-3'     (SEQ ID NO: 1726)

AAT-1407 19 nt Target #1:   5'-CAUGUUUUAGAGGCCAUA-3'     (SEQ ID NO: 1331)

AAT-1407 19 nt Target #2:   5'-CCAUGUUUUAGAGGCCAU-3'     (SEQ ID NO: 1529)

AAT-1407 19 nt Target #3:   5'-GCCAUGUUUUAGAGGCCA-3'     (SEQ ID NO: 1727)

AAT-1408 19 nt Target #1:   5'-AUGUUUUAGAGGCCAUAC-3'     (SEQ ID NO: 1332)

AAT-1408 19 nt Target #2:   5'-CAUGUUUUAGAGGCCAUA-3'     (SEQ ID NO: 1530)

AAT-1408 19 nt Target #3:   5'-CCAUGUUUUAGAGGCCAU-3'     (SEQ ID NO: 1728)

AAT-1409 19 nt Target #1:   5'-UGUUUUAGAGGCCAUACC-3'     (SEQ ID NO: 1333)

AAT-1409 19 nt Target #2:   5'-AUGUUUUAGAGGCCAUAC-3'     (SEQ ID NO: 1531)

AAT-1409 19 nt Target #3:   5'-CAUGUUUUAGAGGCCAUA-3'     (SEQ ID NO: 1729)

AAT-1410 19 nt Target #1:   5'-GUUUUAGAGGCCAUACCC-3'     (SEQ ID NO: 1334)

AAT-1410 19 nt Target #2:   5'-UGUUUUAGAGGCCAUACC-3'     (SEQ ID NO: 1532)

AAT-1410 19 nt Target #3:   5'-AUGUUUUAGAGGCCAUAC-3'     (SEQ ID NO: 1730)

AAT-1411 19 nt Target #1:   5'-UUUUAGAGGCCAUACCCA-3'     (SEQ ID NO: 1335)

AAT-1411 19 nt Target #2:   5'-GUUUUAGAGGCCAUACCC-3'     (SEQ ID NO: 1533)

AAT-1411 19 nt Target #3:   5'-UGUUUUAGAGGCCAUACC-3'     (SEQ ID NO: 1731)

AAT-1412 19 nt Target #1:   5'-UUUAGAGGCCAUACCCAU-3'     (SEQ ID NO: 1336)

AAT-1412 19 nt Target #2:   5'-UUUUAGAGGCCAUACCCA-3'     (SEQ ID NO: 1534)

AAT-1412 19 nt Target #3:   5'-GUUUUAGAGGCCAUACCC-3'     (SEQ ID NO: 1732)

AAT-1413 19 nt Target #1:   5'-UUAGAGGCCAUACCCAUG-3'     (SEQ ID NO: 1337)

AAT-1413 19 nt Target #2:   5'-UUUAGAGGCCAUACCCAU-3'     (SEQ ID NO: 1535)

AAT-1413 19 nt Target #3:   5'-UUUUAGAGGCCAUACCCA-3'     (SEQ ID NO: 1733)

AAT-1414 19 nt Target #1:   5'-UAGAGGCCAUACCCAUGU-3'     (SEQ ID NO: 1338)

AAT-1414 19 nt Target #2:   5'-UUAGAGGCCAUACCCAUG-3'     (SEQ ID NO: 1536)

AAT-1414 19 nt Target #3:   5'-UUUAGAGGCCAUACCCAU-3'     (SEQ ID NO: 1734)

AAT-1415 19 nt Target #1:   5'-AGAGGCCAUACCCAUGUC-3'     (SEQ ID NO: 1339)

AAT-1415 19 nt Target #2:   5'-UAGAGGCCAUACCCAUGU-3'     (SEQ ID NO: 1537)

AAT-1415 19 nt Target #3:   5'-UUAGAGGCCAUACCCAUG-3'     (SEQ ID NO: 1735)

AAT-1416 19 nt Target #1:   5'-AGAGGCCAUACCCAUGUCU-3'    (SEQ ID NO: 1340)

AAT-1416 19 nt Target #2:   5'-UAGAGGCCAUACCCAUGUC-3'    (SEQ ID NO: 1538)

AAT-1416 19 nt Target #3:   5'-UUAGAGGCCAUACCCAUGU-3'    (SEQ ID NO: 1736)

AAT-1452 19 nt Target #1:   5'-GUUCAACAAACCCUUUGUC-3'    (SEQ ID NO: 1341)

AAT-1452 19 nt Target #2:   5'-AGUUCAACAAACCCUUUGU-3'    (SEQ ID NO: 1539)

AAT-1452 19 nt Target #3:   5'-AAGUUCAACAAACCCUUUG-3'    (SEQ ID NO: 1737)

AAT-1453 19 nt Target #1:   5'-UUCAACAAACCCUUUGUCU-3'    (SEQ ID NO: 1342)

AAT-1453 19 nt Target #2:   5'-GUUCAACAAACCCUUUGUC-3'    (SEQ ID NO: 1540)

AAT-1453 19 nt Target #3:   5'-AGUUCAACAAACCCUUUGU-3'    (SEQ ID NO: 1738)
```

TABLE 6-continued

DsiRNA Component 19 Nucleotide Target
Sequences in α-1 antitrypsin mRNA

| | | |
|---|---|---|
| AAT-1454 19 nt Target #1: | 5'-UCAACAAACCCUUUGUCUU-3' | (SEQ ID NO: 1343) |
| AAT-1454 19 nt Target #2: | 5'-UUCAACAAACCCUUUGUCU-3' | (SEQ ID NO: 1541) |
| AAT-1454 19 nt Target #3: | 5'-GUUCAACAAACCCUUUGUC-3' | (SEQ ID NO: 1739) |
| AAT-1455 19 nt Target #1: | 5'-CAACAAACCCUUUGUCUUC-3' | (SEQ ID NO: 1344) |
| AAT-1455 19 nt Target #2: | 5'-UCAACAAACCCUUUGUCUU-3' | (SEQ ID NO: 1542) |
| AAT-1455 19 nt Target #3: | 5'-UUCAACAAACCCUUUGUCU-3' | (SEQ ID NO: 1740) |
| AAT-1456 19 nt Target #1: | 5'-AACAAACCCUUUGUCUUCU-3' | (SEQ ID NO: 1345) |
| AAT-1456 19 nt Target #2: | 5'-CAACAAACCCUUUGUCUUC-3' | (SEQ ID NO: 1543) |
| AAT-1456 19 nt Target #3: | 5'-UCAACAAACCCUUUGUCUU-3' | (SEQ ID NO: 1741) |
| AAT-1457 19 nt Target #1: | 5'-ACAAACCCUUUGUCUUCUU-3' | (SEQ ID NO: 1346) |
| AAT-1457 19 nt Target #2: | 5'-AACAAACCCUUUGUCUUCU-3' | (SEQ ID NO: 1544) |
| AAT-1457 19 nt Target #3: | 5'-CAACAAACCCUUUGUCUUC-3' | (SEQ ID NO: 1742) |
| AAT-1458 19 nt Target #1: | 5'-CAAACCCUUUGUCUUCUUA-3' | (SEQ ID NO: 1347) |
| AAT-1458 19 nt Target #2: | 5'-ACAAACCCUUUGUCUUCUU-3' | (SEQ ID NO: 1545) |
| AAT-1458 19 nt Target #3: | 5'-AACAAACCCUUUGUCUUCU-3' | (SEQ ID NO: 1743) |
| AAT-1459 19 nt Target #1: | 5'-AAACCCUUUGUCUUCUUAA-3' | (SEQ ID NO: 1348) |
| AAT-1459 19 nt Target #2: | 5'-CAAACCCUUUGUCUUCUUA-3' | (SEQ ID NO: 1546) |
| AAT-1459 19 nt Target #3: | 5'-ACAAACCCUUUGUCUUCUU-3' | (SEQ ID NO: 1744) |
| AAT-1460 19 nt Target #1: | 5'-AACCCUUUGUCUUCUUAAU-3' | (SEQ ID NO: 1349) |
| AAT-1460 19 nt Target #2: | 5'-AAACCCUUUGUCUUCUUAA-3' | (SEQ ID NO: 1547) |
| AAT-1460 19 nt Target #3: | 5'-CAAACCCUUUGUCUUCUUA-3' | (SEQ ID NO: 1745) |
| AAT-1489 19 nt Target #1: | 5'-AAUACCAAGUCUCCCCUCU-3' | (SEQ ID NO: 1350) |
| AAT-1489 19 nt Target #2: | 5'-AAAUACCAAGUCUCCCCUC-3' | (SEQ ID NO: 1548) |
| AAT-1489 19 nt Target #3: | 5'-AAAAUACCAAGUCUCCCCU-3' | (SEQ ID NO: 1746) |
| AAT-1490 19 nt Target #1: | 5'-AUACCAAGUCUCCCCUCUU-3' | (SEQ ID NO: 1351) |
| AAT-1490 19 nt Target #2: | 5'-AAUACCAAGUCUCCCCUCU-3' | (SEQ ID NO: 1549) |
| AAT-1490 19 nt Target #3: | 5'-AAAUACCAAGUCUCCCCUC-3' | (SEQ ID NO: 1747) |
| AAT-1491 19 nt Target #1: | 5'-UACCAAGUCUCCCCUCUUC-3' | (SEQ ID NO: 1352) |
| AAT-1491 19 nt Target #2: | 5'-AUACCAAGUCUCCCCUCUU-3' | (SEQ ID NO: 1550) |
| AAT-1491 19 nt Target #3: | 5'-AAUACCAAGUCUCCCCUCU-3' | (SEQ ID NO: 1748) |
| AAT-1492 19 nt Target #1: | 5'-ACCAAGUCUCCCCUCUUCA-3' | (SEQ ID NO: 1353) |
| AAT-1492 19 nt Target #2: | 5'-UACCAAGUCUCCCCUCUUC-3' | (SEQ ID NO: 1551) |
| AAT-1492 19 nt Target #3: | 5'-AUACCAAGUCUCCCCUCUU-3' | (SEQ ID NO: 1749) |
| AAT-1493 19 nt Target #1: | 5'-CCAAGUCUCCCCUCUUCAU-3' | (SEQ ID NO: 1354) |
| AAT-1493 19 nt Target #2: | 5'-ACCAAGUCUCCCCUCUUCA-3' | (SEQ ID NO: 1552) |
| AAT-1493 19 nt Target #3: | 5'-UACCAAGUCUCCCCUCUUC-3' | (SEQ ID NO: 1750) |
| AAT-1494 19 nt Target #1: | 5'-CAAGUCUCCCCUCUUCAUG-3' | (SEQ ID NO: 1355) |
| AAT-1494 19 nt Target #2: | 5'-CCAAGUCUCCCCUCUUCAU-3' | (SEQ ID NO: 1553) |
| AAT-1494 19 nt Target #3: | 5'-ACCAAGUCUCCCCUCUUCA-3' | (SEQ ID NO: 1751) |

TABLE 6-continued

DsiRNA Component 19 Nucleotide Target
Sequences in α-1 antitrypsin mRNA

```
AAT-1495 19 nt Target #1:  5'-AAGUCUCCCCUCUUCAUGG-3'  (SEQ ID NO: 1356)

AAT-1495 19 nt Target #2:  5'-CAAGUCUCCCCUCUUCAUG-3'  (SEQ ID NO: 1554)

AAT-1495 19 nt Target #3:  5'-CCAAGUCUCCCCUCUUCAU-3'  (SEQ ID NO: 1752)

AAT-1496 19 nt Target #1:  5'-AGUCUCCCCUCUUCAUGGG-3'  (SEQ ID NO: 1357)

AAT-1496 19 nt Target #2:  5'-AAGUCUCCCCUCUUCAUGG-3'  (SEQ ID NO: 1555)

AAT-1496 19 nt Target #3:  5'-CAAGUCUCCCCUCUUCAUG-3'  (SEQ ID NO: 1753)

AAT-1497 19 nt Target #1:  5'-GUCUCCCCUCUUCAUGGGA-3'  (SEQ ID NO: 1358)

AAT-1497 19 nt Target #2:  5'-AGUCUCCCCUCUUCAUGGG-3'  (SEQ ID NO: 1556)

AAT-1497 19 nt Target #3:  5'-AAGUCUCCCCUCUUCAUGG-3'  (SEQ ID NO: 1754)

AAT-1499 19 nt Target #1:  5'-CUCCCCUCUUCAUGGGAAA-3'  (SEQ ID NO: 1359)

AAT-1499 19 nt Target #2:  5'-UCUCCCCUCUUCAUGGGAA-3'  (SEQ ID NO: 1557)

AAT-1499 19 nt Target #3:  5'-GUCUCCCCUCUUCAUGGGA-3'  (SEQ ID NO: 1755)

AAT-1501 19 nt Target #1:  5'-CCCCUCUUCAUGGGAAAAG-3'  (SEQ ID NO: 1360)

AAT-1501 19 nt Target #2:  5'-UCCCCUCUUCAUGGGAAAA-3'  (SEQ ID NO: 1558)

AAT-1501 19 nt Target #3:  5'-CUCCCCUCUUCAUGGGAAA-3'  (SEQ ID NO: 1756)

AAT-1502 19 nt Target #1:  5'-CCCUCUUCAUGGGAAAAGU-3'  (SEQ ID NO: 1361)

AAT-1502 19 nt Target #2:  5'-CCCCUCUUCAUGGGAAAAG-3'  (SEQ ID NO: 1559)

AAT-1502 19 nt Target #3:  5'-UCCCCUCUUCAUGGGAAAA-3'  (SEQ ID NO: 1757)

AAT-1503 19 nt Target #1:  5'-CCUCUUCAUGGGAAAAGUG-3'  (SEQ ID NO: 1362)

AAT-1503 19 nt Target #2:  5'-CCCUCUUCAUGGGAAAAGU-3'  (SEQ ID NO: 1560)

AAT-1503 19 nt Target #3:  5'-CCCCUCUUCAUGGGAAAAG-3'  (SEQ ID NO: 1758)

AAT-1504 19 nt Target #1:  5'-CUCUUCAUGGGAAAAGUGG-3'  (SEQ ID NO: 1363)

AAT-1504 19 nt Target #2:  5'-CCUCUUCAUGGGAAAAGUG-3'  (SEQ ID NO: 1561)

AAT-1504 19 nt Target #3:  5'-CCCUCUUCAUGGGAAAAGU-3'  (SEQ ID NO: 1759)

AAT-1505 19 nt Target #1:  5'-UCUUCAUGGGAAAAGUGGU-3'  (SEQ ID NO: 1364)

AAT-1505 19 nt Target #2:  5'-CUCUUCAUGGGAAAAGUGG-3'  (SEQ ID NO: 1562)

AAT-1505 19 nt Target #3:  5'-CCUCUUCAUGGGAAAAGUG-3'  (SEQ ID NO: 1760)

AAT-1506 19 nt Target #1:  5'-CUUCAUGGGAAAAGUGGUG-3'  (SEQ ID NO: 1365)

AAT-1506 19 nt Target #2:  5'-UCUUCAUGGGAAAAGUGGU-3'  (SEQ ID NO: 1563)

AAT-1506 19 nt Target #3:  5'-CUCUUCAUGGGAAAAGUGG-3'  (SEQ ID NO: 1761)

AAT-1507 19 nt Target #1:  5'-UUCAUGGGAAAAGUGGUGA-3'  (SEQ ID NO: 1366)

AAT-1507 19 nt Target #2:  5'-CUUCAUGGGAAAAGUGGUG-3'  (SEQ ID NO: 1564)

AAT-1507 19 nt Target #3:  5'-UCUUCAUGGGAAAAGUGGU-3'  (SEQ ID NO: 1762)

AAT-1508 19 nt Target #1:  5'-UCAUGGGAAAAGUGGUGAA-3'  (SEQ ID NO: 1367)

AAT-1508 19 nt Target #2:  5'-UUCAUGGGAAAAGUGGUGA-3'  (SEQ ID NO: 1565)

AAT-1508 19 nt Target #3:  5'-CUUCAUGGGAAAAGUGGUG-3'  (SEQ ID NO: 1763)

AAT-1509 19 nt Target #1:  5'-CAUGGGAAAAGUGGUGAAU-3'  (SEQ ID NO: 1368)

AAT-1509 19 nt Target #2:  5'-UCAUGGGAAAAGUGGUGAA-3'  (SEQ ID NO: 1566)
```

TABLE 6-continued

DsiRNA Component 19 Nucleotide Target
Sequences in α-1 antitrypsin mRNA

| | | |
|---|---|---|
| AAT-1509 19 nt Target #3: | 5'-UUCAUGGGAAAAGUGGUGA-3' | (SEQ ID NO: 1764) |
| AAT-1510 19 nt Target #1: | 5'-AUGGGAAAAGUGGUGAAUC-3' | (SEQ ID NO: 1369) |
| AAT-1510 19 nt Target #2: | 5'-CAUGGGAAAAGUGGUGAAU-3' | (SEQ ID NO: 1567) |
| AAT-1510 19 nt Target #3: | 5'-UCAUGGGAAAAGUGGUGAA-3' | (SEQ ID NO: 1765) |
| AAT-1511 19 nt Target #1: | 5'-UGGGAAAAGUGGUGAAUCC-3' | (SEQ ID NO: 1370) |
| AAT-1511 19 nt Target #2: | 5'-AUGGGAAAAGUGGUGAAUC-3' | (SEQ ID NO: 1568) |
| AAT-1511 19 nt Target #3: | 5'-CAUGGGAAAAGUGGUGAAU-3' | (SEQ ID NO: 1766) |
| AAT-1512 19 nt Target #1: | 5'-GGGAAAAGUGGUGAAUCCC-3' | (SEQ ID NO: 1371) |
| AAT-1512 19 nt Target #2: | 5'-UGGGAAAAGUGGUGAAUCC-3' | (SEQ ID NO: 1569) |
| AAT-1512 19 nt Target #3: | 5'-AUGGGAAAAGUGGUGAAUC-3' | (SEQ ID NO: 1767) |
| AAT-1513 19 nt Target #1: | 5'-GGAAAAGUGGUGAAUCCCA-3' | (SEQ ID NO: 1372) |
| AAT-1513 19 nt Target #2: | 5'-GGGAAAAGUGGUGAAUCCC-3' | (SEQ ID NO: 1570) |
| AAT-1513 19 nt Target #3: | 5'-UGGGAAAAGUGGUGAAUCC-3' | (SEQ ID NO: 1768) |
| AAT-1514 19 nt Target #1: | 5'-GAAAAGUGGUGAAUCCCAC-3' | (SEQ ID NO: 1373) |
| AAT-1514 19 nt Target #2: | 5'-GGAAAAGUGGUGAAUCCCA-3' | (SEQ ID NO: 1571) |
| AAT-1514 19 nt Target #3: | 5'-GGGAAAAGUGGUGAAUCCC-3' | (SEQ ID NO: 1769) |
| AAT-1515 19 nt Target #1: | 5'-AAAAGUGGUGAAUCCCACC-3' | (SEQ ID NO: 1374) |
| AAT-1515 19 nt Target #2: | 5'-GAAAAGUGGUGAAUCCCAC-3' | (SEQ ID NO: 1572) |
| AAT-1515 19 nt Target #3: | 5'-GGAAAAGUGGUGAAUCCCA-3' | (SEQ ID NO: 1770) |
| AAT-1516 19 nt Target #1: | 5'-AAAGUGGUGAAUCCCACCC-3' | (SEQ ID NO: 1375) |
| AAT-1516 19 nt Target #2: | 5'-AAAAGUGGUGAAUCCCACC-3' | (SEQ ID NO: 1573) |
| AAT-1516 19 nt Target #3: | 5'-GAAAAGUGGUGAAUCCCAC-3' | (SEQ ID NO: 1771) |
| AAT-1517 19 nt Target #1: | 5'-AAGUGGUGAAUCCCACCCA-3' | (SEQ ID NO: 1376) |
| AAT-1517 19 nt Target #2: | 5'-AAAGUGGUGAAUCCCACCC-3' | (SEQ ID NO: 1574) |
| AAT-1517 19 nt Target #3: | 5'-AAAAGUGGUGAAUCCCACC-3' | (SEQ ID NO: 1772) |
| AAT-2872 19 nt Target #1: | 5'-CGAUAGUUCAAAAUGGUGA-3' | (SEQ ID NO: 1377) |
| AAT-2872 19 nt Target #2: | 5'-UCGAUAGUUCAAAAUGGUG-3' | (SEQ ID NO: 1575) |
| AAT-2872 19 nt Target #3: | 5'-UUCGAUAGUUCAAAAUGGU-3' | (SEQ ID NO: 1773) |
| AAT-2880 19 nt Target #1: | 5'-CAAAAUGGUGAAAUUAGCA-3' | (SEQ ID NO: 1378) |
| AAT-2880 19 nt Target #2: | 5'-UCAAAAUGGUGAAAUUAGC-3' | (SEQ ID NO: 1576) |
| AAT-2880 19 nt Target #3: | 5'-UUCAAAAUGGUGAAAUUAG-3' | (SEQ ID NO: 1774) |
| AAT-3167 19 nt Target #1: | 5'-UUGGUAUGAUGUUCAAGUU-3' | (SEQ ID NO: 1379) |
| AAT-3167 19 nt Target #2: | 5'-GUUGGUAUGAUGUUCAAGU-3' | (SEQ ID NO: 1577) |
| AAT-3167 19 nt Target #3: | 5'-AGUUGGUAUGAUGUUCAAG-3' | (SEQ ID NO: 1775) |
| AAT-3169 19 nt Target #1: | 5'-GGUAUGAUGUUCAAGUUAG-3' | (SEQ ID NO: 1380) |
| AAT-3169 19 nt Target #2: | 5'-UGGUAUGAUGUUCAAGUUA-3' | (SEQ ID NO: 1578) |
| AAT-3169 19 nt Target #3: | 5'-UUGGUAUGAUGUUCAAGUU-3' | (SEQ ID NO: 1776) |
| AAT-3170 19 nt Target #1: | 5'-GUAUGAUGUUCAAGUUAGA-3' | (SEQ ID NO: 1381) |
| AAT-3170 19 nt Target #2: | 5'-GGUAUGAUGUUCAAGUUAG-3' | (SEQ ID NO: 1579) |

TABLE 6-continued

DsiRNA Component 19 Nucleotide Target
Sequences in α-1 antitrypsin mRNA

AAT-3170 19 nt Target #3:   5'-UGGUAUGAUGUUCAAGUUA-3'   (SEQ ID NO: 1777)

AAT-3172 19 nt Target #1:   5'-AUGAUGUUCAAGUUAGAUA-3'   (SEQ ID NO: 1382)

AAT-3172 19 nt Target #2:   5'-UAUGAUGUUCAAGUUAGAU-3'   (SEQ ID NO: 1580)

AAT-3172 19 nt Target #3:   5'-GUAUGAUGUUCAAGUUAGA-3'   (SEQ ID NO: 1778)

AAT-3175 19 nt Target #1:   5'-AUGUUCAAGUUAGAUAACA-3'   (SEQ ID NO: 1383)

AAT-3175 19 nt Target #2:   5'-GAUGUUCAAGUUAGAUAAC-3'   (SEQ ID NO: 1581)

AAT-3175 19 nt Target #3:   5'-UGAUGUUCAAGUUAGAUAA-3'   (SEQ ID NO: 1779)

AAT-3180 19 nt Target #1:   5'-CAAGUUAGAUAACAAAAUG-3'   (SEQ ID NO: 1384)

AAT-3180 19 nt Target #2:   5'-UCAAGUUAGAUAACAAAAU-3'   (SEQ ID NO: 1582)

AAT-3180 19 nt Target #3:   5'-UUCAAGUUAGAUAACAAAA-3'   (SEQ ID NO: 1780)

AAT-3181 19 nt Target #1:   5'-AAGUUAGAUAACAAAAUGU-3'   (SEQ ID NO: 1385)

AAT-3181 19 nt Target #2:   5'-CAAGUUAGAUAACAAAAUG-3'   (SEQ ID NO: 1583)

AAT-3181 19 nt Target #3:   5'-UCAAGUUAGAUAACAAAAU-3'   (SEQ ID NO: 1781)

AAT-3182 19 nt Target #1:   5'-AGUUAGAUAACAAAAUGUU-3'   (SEQ ID NO: 1386)

AAT-3182 19 nt Target #2:   5'-AAGUUAGAUAACAAAAUGU-3'   (SEQ ID NO: 1584)

AAT-3182 19 nt Target #3:   5'-CAAGUUAGAUAACAAAAUG-3'   (SEQ ID NO: 1782)

TABLE 7

Additional Human Anti-α-1 antitrypsin DsiRNA Agents (Asymmetrics)

```
                5'-GCGUUUAGGCAUGUUUAACAUCCag-3'    (SEQ ID NO: 1783)
                3'-UUCGCAAAUCCGUACAAAUUGUAGGUC-5'  (SEQ ID NO: 1814)
AAT-1023 Target: 5'-AAGCGTTTAGGCATGTTTAACATCCAG-3' (SEQ ID NO: 1845)

5'-CGUUUAGGCAUGUUUAACAUCCAgc-3'   (SEQ ID NO: 1784)
                3'-UCGCAAAUCCGUACAAAUUGUAGGUCG-5' (SEQ ID NO: 1815)
AAT-1024 Target: 5'-AGCGTTTAGGCATGTTTAACATCCAGC-3' (SEQ ID NO: 1846)

5'-GGCCAUGUUUUUAGAGGCCAUACcc-3'   (SEQ ID NO: 1785)
                3'-CCCCGGUACAAAAAUCUCCGGUAUGGG-5' (SEQ ID NO: 1816)
AAT-1404 Target: 5'-GGGGCCATGTTTTTAGAGGCCATACCC-3' (SEQ ID NO: 1847)

5'-ACCCUUUGUCUUCUUAAUGAUUGaa-3'   (SEQ ID NO: 1786)
                3'-UUUGGGAAACAGAAGAAUUACUAACUU-5' (SEQ ID NO: 1817)
AAT-1461 Target: 5'-AAACCCTTTGTCTTCTTAATGATTGAA-3' (SEQ ID NO: 1848)

5'-CCCUUUGUCUUCUUAAUGAUUGAac-3'   (SEQ ID NO: 1787)
                3'-UUGGGAAACAGAAGAAUUACUAACUUG-5' (SEQ ID NO: 1818)
AAT-1462 Target: 5'-AACCCTTTGTCTTCTTAATGATTGAAC-3' (SEQ ID NO: 1849)

5'-CCUUUGUCUUCUUAAUGAUUGAAca-3'   (SEQ ID NO: 1788)
                3'-UGGGAAACAGAAGAAUUACUAACUUGU-5' (SEQ ID NO: 1819)
AAT-1463 Target: 5'-ACCCTTTGTCTTCTTAATGATTGAACA-3' (SEQ ID NO: 1850)

5'-CUUUGUCUUCUUAAUGAUUGAACaa-3'   (SEQ ID NO: 1789)
                3'-GGGAAACAGAAGAAUUACUAACUUGUU-5' (SEQ ID NO: 1820)
AAT-1464 Target: 5'-CCCTTTGTCTTCTTAATGATTGAACAA-3' (SEQ ID NO: 1851)

5'-UUUGUCUUCUUAAUGAUUGAACAaa-3'   (SEQ ID NO: 1790)
                3'-GGAAACAGAAGAAUUACUAACUUGUUU-5' (SEQ ID NO: 1821)
AAT-1465 Target: 5'-CCTTTGTCTTCTTAATGATTGAACAAA-3' (SEQ ID NO: 1852)

5'-UUGUCUUCUUAAUGAUUGAACAAaa-3'   (SEQ ID NO: 1791)
                3'-GAAACAGAAGAAUUACUAACUUGUUUU-5' (SEQ ID NO: 1822)
AAT-1466 Target: 5'-CTTTGTCTTCTTAATGATTGAACAAAA-3' (SEQ ID NO: 1853)
```

TABLE 7-continued

Additional Human Anti-α-1 antitrypsin DsiRNA Agents (Asymmetrics)

```
                    5'-UGUCUUCUUAAUGAUUGAACAAAat-3'        (SEQ ID NO: 1792)
                    3'-AAACAGAAGAAUUACUAACUUGUUUUA-5'      (SEQ ID NO: 1823)
AAT-1467  Target:   5'-TTTGTCTTCTTAATGATTGAACAAAAT-3'      (SEQ ID NO: 1854)

5'-GUCUUCUUAAUGAUUGAACAAAAta-3'        (SEQ ID NO: 1793)
                    3'-AACAGAAGAAUUACUAACUUGUUUUAU-5'      (SEQ ID NO: 1824)
AAT-1468  Target:   5'-TTGTCTTCTTAATGATTGAACAAAATA-3'      (SEQ ID NO: 1855)

5'-UCUUCUUAAUGAUUGAACAAAAUac-3'        (SEQ ID NO: 1794)
                    3'-ACAGAAGAAUUACUAACUUGUUUUAUG-5'      (SEQ ID NO: 1825)
AAT-1469  Target:   5'-TGTCTTCTTAATGATTGAACAAAATAC-3'      (SEQ ID NO: 1856)

5'-CUUCUUAAUGAUUGAACAAAAUAcc-3'        (SEQ ID NO: 1795)
                    3'-CAGAAGAAUUACUAACUUGUUUUAUGG-5'      (SEQ ID NO: 1826)
AAT-1470  Target:   5'-GTCTTCTTAATGATTGAACAAAATACC-3'      (SEQ ID NO: 1857)

5'-UUCUUAAUGAUUGAACAAAAUACca-3'        (SEQ ID NO: 1796)
                    3'-AGAAGAAUUACUAACUUGUUUUAUGGU-5'      (SEQ ID NO: 1827)
AAT-1471  Target:   5'-TCTTCTTAATGATTGAACAAAATACCA-3'      (SEQ ID NO: 1858)

5'-UCUUAAUGAUUGAACAAAAUACCaa-3'        (SEQ ID NO: 1797)
                    3'-GAAGAAUUACUAACUUGUUUUAUGGUU-5'      (SEQ ID NO: 1828)
AAT-1472  Target:   5'-CTTCTTAATGATTGAACAAAATACCAA-3'      (SEQ ID NO: 1859)

5'-CUUAAUGAUUGAACAAAAUACCAag-3'        (SEQ ID NO: 1798)
                    3'-AAGAAUUACUAACUUGUUUUAUGGUUC-5'      (SEQ ID NO: 1829)
AAT-1473  Target:   5'-TTCTTAATGATTGAACAAAATACCAAG-3'      (SEQ ID NO: 1860)

5'-UUAAUGAUUGAACAAAAUACCAAgt-3'        (SEQ ID NO: 1799)
                    3'-AGAAUUACUAACUUGUUUUAUGGUUCA-5'      (SEQ ID NO: 1830)
AAT-1474  Target:   5'-TCTTAATGATTGAACAAAATACCAAGT-3'      (SEQ ID NO: 1861)

5'-UAAUGAUUGAACAAAAUACCAAGtc-3'        (SEQ ID NO: 1800)
                    3'-GAAUUACUAACUUGUUUUAUGGUUCAG-5'      (SEQ ID NO: 1831)
AAT-1475  Target:   5'-CTTAATGATTGAACAAAATACCAAGTC-3'      (SEQ ID NO: 1862)

5'-AAUGAUUGAACAAAAUACCAAGUct-3'        (SEQ ID NO: 1801)
                    3'-AAUUACUAACUUGUUUUAUGGUUCAGA-5'      (SEQ ID NO: 1832)
AAT-1476  Target:   5'-TTAATGATTGAACAAAATACCAAGTCT-3'      (SEQ ID NO: 1863)

5'-AUGAUUGAACAAAAUACCAAGUCtc-3'        (SEQ ID NO: 1802)
                    3'-AUUACUAACUUGUUUUAUGGUUCAGAG-5'      (SEQ ID NO: 1833)
AAT-1477  Target:   5'-TAATGATTGAACAAAATACCAAGTCTC-3'      (SEQ ID NO: 1864)

5'-UGAUUGAACAAAAUACCAAGUCUcc-3'        (SEQ ID NO: 1803)
                    3'-UUACUAACUUGUUUUAUGGUUCAGAGG-5'      (SEQ ID NO: 1834)
AAT-1478  Target:   5'-AATGATTGAACAAAATACCAAGTCTCC-3'      (SEQ ID NO: 1865)

5'-GAUUGAACAAAAUACCAAGUCUCcc-3'        (SEQ ID NO: 1804)
                    3'-UACUAACUUGUUUUAUGGUUCAGAGGG-5'      (SEQ ID NO: 1835)
AAT-1479  Target:   5'-ATGATTGAACAAAATACCAAGTCTCCC-3'      (SEQ ID NO: 1866)

5'-AUUGAACAAAAUACCAAGUCUCCcc-3'        (SEQ ID NO: 1805)
                    3'-ACUAACUUGUUUUAUGGUUCAGAGGGG-5'      (SEQ ID NO: 1836)
AAT-1480  Target:   5'-TGATTGAACAAAATACCAAGTCTCCCC-3'      (SEQ ID NO: 1867)

5'-UUGAACAAAAUACCAAGUCUCCCct-3'        (SEQ ID NO: 1806)
                    3'-CUAACUUGUUUUAUGGUUCAGAGGGGA-5'      (SEQ ID NO: 1837)
AAT-1481  Target:   5'-GATTGAACAAAATACCAAGTCTCCCCT-3'      (SEQ ID NO: 1868)

5'-UGAACAAAAUACCAAGUCUCCCCtc-3'        (SEQ ID NO: 1807)
                    3'-UAACUUGUUUUAUGGUUCAGAGGGGAG-5'      (SEQ ID NO: 1838)
AAT-1482  Target:   5'-ATTGAACAAAATACCAAGTCTCCCCTC-3'      (SEQ ID NO: 1869)

5'-GAACAAAAUACCAAGUCUCCCCUct-3'        (SEQ ID NO: 1808)
                    3'-AACUUGUUUUAUGGUUCAGAGGGGAGA-5'      (SEQ ID NO: 1839)
AAT-1483  Target:   5'-TTGAACAAAATACCAAGTCTCCCCTCT-3'      (SEQ ID NO: 1870)

5'-AACAAAAUACCAAGUCUCCCCUCtt-3'        (SEQ ID NO: 1809)
                    3'-ACUUGUUUUAUGGUUCAGAGGGGAGAA-5'      (SEQ ID NO: 1840)
AAT-1484  Target:   5'-TGAACAAAATACCAAGTCTCCCCTCTT-3'      (SEQ ID NO: 1871)

5'-ACAAAAUACCAAGUCUCCCCUCUtc-3'        (SEQ ID NO: 1810)
                    3'-CUUGUUUUAUGGUUCAGAGGGGAGAAG-5'      (SEQ ID NO: 1841)
AAT-1485  Target:   5'-GAACAAAATACCAAGTCTCCCCTCTTC-3'      (SEQ ID NO: 1872)
```

TABLE 7-continued

Additional Human Anti-α-1 antitrypsin DsiRNA Agents (Asymmetrics)

```
                5'-CAAAAUACCAAGUCUCCCCUCUUCa-3'     (SEQ ID NO: 1811)
                3'-UUGUUUUAUGGUUCAGAGGGGAGAAGU-5'   (SEQ ID NO: 1842)
AAT-1486 Target: 5'-AACAAAATACCAAGTCTCCCCTCTTCA-3'  (SEQ ID NO: 1873)

5'-AAAAUACCAAGUCUCCCCUCUUCat-3'     (SEQ ID NO: 1812)
                3'-UGUUUUAUGGUUCAGAGGGGAGAAGUA-5'   (SEQ ID NO: 1843)
AAT-1487 Target: 5'-ACAAAATACCAAGTCTCCCCTCTTCAT-3'  (SEQ ID NO: 1874)

5'-AAAUACCAAGUCUCCCCUCUUCAtg-3'     (SEQ ID NO: 1813)
                3'-GUUUUAUGGUUCAGAGGGGAGAAGUAC-5'   (SEQ ID NO: 1844)
AAT-1488 Target: 5'-CAAAATACCAAGTCTCCCCTCTTCATG-3'  (SEQ ID NO: 1875)
```

TABLE 8

Additional Human Anti-α-1 antitrypsin DsiRNAs, Unmodified Duplexes (Asymmetrics)

```
                5'-GCGUUUAGGCAUGUUUAACAUCCAG-3'     (SEQ ID NO: 1876)
                3'-UUCGCAAAUCCGUACAAAUUGUAGGUC-5'   (SEQ ID NO: 1814)
AAT-1023 Target: 5'-AAGCGTTTAGGCATGTTTAACATCCAG-3'  (SEQ ID NO: 1845)

5'-CGUUUAGGCAUGUUUAACAUCCAGC-3'     (SEQ ID NO: 1877)
                3'-UCGCAAAUCCGUACAAAUUGUAGGUCG-5'   (SEQ ID NO: 1815)
AAT-1024 Target: 5'-AGCGTTTAGGCATGTTTAACATCCAGC-3'  (SEQ ID NO: 1846)

5'-GGCCAUGUUUUUAGAGGCCAUACCC-3'     (SEQ ID NO: 1878)
                3'-CCCCGGUACAAAAAUCUCCGGUAUGGG-5'   (SEQ ID NO: 1816)
AAT-1404 Target: 5'-GGGGCCATGTTTTTAGAGGCCATACCC-3'  (SEQ ID NO: 1847)

5'-ACCCUUUGUCUUCUUAAUGAUUGAA-3'     (SEQ ID NO: 1879)
                3'-UUUGGGAAACAGAAGAAUUACUAACUU-5'   (SEQ ID NO: 1817)
AAT-1461 Target: 5'-AAACCCTTTGTCTTCTTAATGATTGAA-3'  (SEQ ID NO: 1848)

5'-CCCUUUGUCUUCUUAAUGAUUGAAC-3'     (SEQ ID NO: 1880)
                3'-UUGGGAAACAGAAGAAUUACUAACUUG-5'   (SEQ ID NO: 1818)
AAT-1462 Target: 5'-AACCCTTTGTCTTCTTAATGATTGAAC-3'  (SEQ ID NO: 1849)

5'-CCUUUGUCUUCUUAAUGAUUGAACA-3'     (SEQ ID NO: 1881)
                3'-UGGGAAACAGAAGAAUUACUAACUUGU-5'   (SEQ ID NO: 1819)
AAT-1463 Target: 5'-ACCCTTTGTCTTCTTAATGATTGAACA-3'  (SEQ ID NO: 1850)

5'-CUUUGUCUUCUUAAUGAUUGAACAA-3'     (SEQ ID NO: 1882)
                3'-GGGAAACAGAAGAAUUACUAACUUGUU-5'   (SEQ ID NO: 1820)
AAT-1464 Target: 5'-CCCTTTGTCTTCTTAATGATTGAACAA-3'  (SEQ ID NO: 1851)

5'-UUUGUCUUCUUAAUGAUUGAACAAA-3'     (SEQ ID NO: 1883)
                3'-GGAAACAGAAGAAUUACUAACUUGUUU-5'   (SEQ ID NO: 1821)
AAT-1465 Target: 5'-CCTTTGTCTTCTTAATGATTGAACAAA-3'  (SEQ ID NO: 1852)

5'-UUGUCUUCUUAAUGAUUGAACAAAA-3'     (SEQ ID NO: 1884)
                3'-GAAACAGAAGAAUUACUAACUUGUUUU-5'   (SEQ ID NO: 1822)
AAT-1466 Target: 5'-CTTTGTCTTCTTAATGATTGAACAAAA-3'  (SEQ ID NO: 1853)

5'-UGUCUUCUUAAUGAUUGAACAAAAU-3'     (SEQ ID NO: 1885)
                3'-AAACAGAAGAAUUACUAACUUGUUUUA-5'   (SEQ ID NO: 1823)
AAT-1467 Target: 5'-TTTGTCTTCTTAATGATTGAACAAAAT-3'  (SEQ ID NO: 1854)

5'-GUCUUCUUAAUGAUUGAACAAAAUA-3'     (SEQ ID NO: 1886)
                3'-AACAGAAGAAUUACUAACUUGUUUUAU-5'   (SEQ ID NO: 1824)
AAT-1468 Target: 5'-TTGTCTTCTTAATGATTGAACAAAATA-3'  (SEQ ID NO: 1855)

5'-UCUUCUUAAUGAUUGAACAAAAUAC-3'     (SEQ ID NO: 1887)
                3'-ACAGAAGAAUUACUAACUUGUUUUAUG-5'   (SEQ ID NO: 1825)
AAT-1469 Target: 5'-TGTCTTCTTAATGATTGAACAAAATAC-3'  (SEQ ID NO: 1856)

5'-CUUCUUAAUGAUUGAACAAAAUACC-3'     (SEQ ID NO: 1888)
                3'-CAGAAGAAUUACUAACUUGUUUUAUGG-5'   (SEQ ID NO: 1826)
AAT-1470 Target: 5'-GTCTTCTTAATGATTGAACAAAATACC-3'  (SEQ ID NO: 1857)

5'-UUCUUAAUGAUUGAACAAAAUACCA-3'     (SEQ ID NO: 1889)
                3'-AGAAGAAUUACUAACUUGUUUUAUGGU-5'   (SEQ ID NO: 1827)
AAT-1471 Target: 5'-TCTTCTTAATGATTGAACAAAATACCA-3'  (SEQ ID NO: 1858)
```

TABLE 8-continued

Additional Human Anti-α-1 antitrypsin DsiRNAs, Unmodified Duplexes (Asymmetrics)

|  |  |  |
|---|---|---|
|  | 5'-UCUUAAUGAUUGAACAAAAUACCAA-3' | (SEQ ID NO: 1890) |
|  | 3'-GAAGAAUUACUAACUUGUUUUAUGGUU-5' | (SEQ ID NO: 1828) |
| AAT-1472 Target: | 5'-CTTCTTAATGATTGAACAAAATACCAA-3' | (SEQ ID NO: 1859) |
|  | 5'-CUUAAUGAUUGAACAAAAUACCAAG-3' | (SEQ ID NO: 1891) |
|  | 3'-AAGAAUUACUAACUUGUUUUAUGGUUC-5' | (SEQ ID NO: 1829) |
| AAT-1473 Target: | 5'-TTCTTAATGATTGAACAAAATACCAAG-3' | (SEQ ID NO: 1860) |
|  | 5'-UUAAUGAUUGAACAAAAUACCAAGU-3' | (SEQ ID NO: 1892) |
|  | 3'-AGAAUUACUAACUUGUUUUAUGGUUCA-5' | (SEQ ID NO: 1830) |
| AAT-1474 Target: | 5'-TCTTAATGATTGAACAAAATACCAAGT-3' | (SEQ ID NO: 1861) |
|  | 5'-UAAUGAUUGAACAAAAUACCAAGUC-3' | (SEQ ID NO: 1893) |
|  | 3'-GAAUUACUAACUUGUUUUAUGGUUCAG-5' | (SEQ ID NO: 1831) |
| AAT-1475 Target: | 5'-CTTAATGATTGAACAAAATACCAAGTC-3' | (SEQ ID NO: 1862) |
|  | 5'-AAUGAUUGAACAAAAUACCAAGUCU-3' | (SEQ ID NO: 1894) |
|  | 3'-AAUUACUAACUUGUUUUAUGGUUCAGA-5' | (SEQ ID NO: 1832) |
| AAT-1476 Target: | 5'-TTAATGATTGAACAAAATACCAAGTCT-3' | (SEQ ID NO: 1863) |
|  | 5'-AUGAUUGAACAAAAUACCAAGUCUC-3' | (SEQ ID NO: 1895) |
|  | 3'-AUUACUAACUUGUUUUAUGGUUCAGAG-5' | (SEQ ID NO: 1833) |
| AAT-1477 Target: | 5'-TAATGATTGAACAAAATACCAAGTCTC-3' | (SEQ ID NO: 1864) |
|  | 5'-UGAUUGAACAAAAUACCAAGUCUCC-3' | (SEQ ID NO: 1896) |
|  | 3'-UUACUAACUUGUUUUAUGGUUCAGAGG-5' | (SEQ ID NO: 1834) |
| AAT-1478 Target: | 5'-AATGATTGAACAAAATACCAAGTCTCC-3' | (SEQ ID NO: 1865) |
|  | 5'-GAUUGAACAAAAUACCAAGUCUCCC-3' | (SEQ ID NO: 1897) |
|  | 3'-UACUAACUUGUUUUAUGGUUCAGAGGG-5' | (SEQ ID NO: 1835) |
| AAT-1479 Target: | 5'-ATGATTGAACAAAATACCAAGTCTCCC-3' | (SEQ ID NO: 1866) |
|  | 5'-AUUGAACAAAAUACCAAGUCUCCCC-3' | (SEQ ID NO: 1898) |
|  | 3'-ACUAACUUGUUUUAUGGUUCAGAGGGG-5' | (SEQ ID NO: 1836) |
| AAT-1480 Target: | 5'-TGATTGAACAAAATACCAAGTCTCCCC-3' | (SEQ ID NO: 1867) |
|  | 5'-UUGAACAAAAUACCAAGUCUCCCCU-3' | (SEQ ID NO: 1899) |
|  | 3'-CUAACUUGUUUUAUGGUUCAGAGGGGA-5' | (SEQ ID NO: 1837) |
| AAT-1481 Target: | 5'-GATTGAACAAAATACCAAGTCTCCCCT-3' | (SEQ ID NO: 1868) |
|  | 5'-UGAACAAAAUACCAAGUCUCCCCUC-3' | (SEQ ID NO: 1900) |
|  | 3'-UAACUUGUUUUAUGGUUCAGAGGGGAG-5' | (SEQ ID NO: 1838) |
| AAT-1482 Target: | 5'-ATTGAACAAAATACCAAGTCTCCCCTC-3' | (SEQ ID NO: 1869) |
|  | 5'-GAACAAAAUACCAAGUCUCCCCUCU-3' | (SEQ ID NO: 1901) |
|  | 3'-AACUUGUUUUAUGGUUCAGAGGGGAGA-5' | (SEQ ID NO: 1839) |
| AAT-1483 Target: | 5'-TTGAACAAAATACCAAGTCTCCCCTCT-3' | (SEQ ID NO: 1870) |
|  | 5'-AACAAAAUACCAAGUCUCCCCUCUU-3' | (SEQ ID NO: 1902) |
|  | 3'-ACUUGUUUUAUGGUUCAGAGGGGAGAA-5' | (SEQ ID NO: 1840) |
| AAT-1484 Target: | 5'-TGAACAAAATACCAAGTCTCCCCTCTT-3' | (SEQ ID NO: 1871) |
|  | 5'-ACAAAAUACCAAGUCUCCCCUCUUC-3' | (SEQ ID NO: 1903) |
|  | 3'-CUUGUUUUAUGGUUCAGAGGGGAGAAG-5' | (SEQ ID NO: 1841) |
| AAT-1485 Target: | 5'-GAACAAAATACCAAGTCTCCCCTCTTC-3' | (SEQ ID NO: 1872) |
|  | 5'-CAAAAUACCAAGUCUCCCCUCUUCA-3' | (SEQ ID NO: 1904) |
|  | 3'-UUGUUUUAUGGUUCAGAGGGGAGAAGU-5' | (SEQ ID NO: 1842) |
| AAT-1486 Target: | 5'-AACAAAATACCAAGTCTCCCCTCTTCA-3' | (SEQ ID NO: 1873) |
|  | 5'-AAAAUACCAAGUCUCCCCUCUUCAU-3' | (SEQ ID NO: 1905) |
|  | 3'-UGUUUUAUGGUUCAGAGGGGAGAAGUA-5' | (SEQ ID NO: 1843) |
| AAT-1487 Target: | 5'-ACAAAATACCAAGTCTCCCCTCTTCAT-3' | (SEQ ID NO: 1874) |
|  | 5'-AAAUACCAAGUCUCCCCUCUUCAUG-3' | (SEQ ID NO: 1906) |
|  | 3'-GUUUUAUGGUUCAGAGGGGAGAAGUAC-5' | (SEQ ID NO: 1844) |
| AAT-1488 Target: | 5'-CAAAATACCAAGTCTCCCCTCTTCATG-3' | (SEQ ID NO: 1875) |

TABLE 9

Additional DsiRNA Target Sequences (21mers) in α-1 antitrypsin mRNA

| | | |
|---|---|---|
| AAT-1023 21 nt Target: | 5'-AAGCGUUUAGGCAUGUUUAAC-3' | (SEQ ID NO: 1907) |
| AAT-1024 21 nt Target: | 5'-AGCGUUUAGGCAUGUUUAACA-3' | (SEQ ID NO: 1908) |
| AAT-1404 21 nt Target: | 5'-GGGGCCAUGUUUUUAGAGGCC-3' | (SEQ ID NO: 1909) |
| AAT-1461 21 nt Target: | 5'-AAACCCUUUGUCUUCUUAAUG-3' | (SEQ ID NO: 1910) |
| AAT-1462 21 nt Target: | 5'-AACCCUUUGUCUUCUUAAUGA-3' | (SEQ ID NO: 1911) |
| AAT-1463 21 nt Target: | 5'-ACCCUUUGUCUUCUUAAUGAU-3' | (SEQ ID NO: 1912) |
| AAT-1464 21 nt Target: | 5'-CCCUUUGUCUUCUUAAUGAUU-3' | (SEQ ID NO: 1913) |
| AAT-1465 21 nt Target: | 5'-CCUUUGUCUUCUUAAUGAUUG-3' | (SEQ ID NO: 1914) |
| AAT-1466 21 nt Target: | 5'-CUUUGUCUUCUUAAUGAUUGA-3' | (SEQ ID NO: 1915) |
| AAT-1467 21 nt Target: | 5'-UUUGUCUUCUUAAUGAUUGAA-3' | (SEQ ID NO: 1916) |
| AAT-1468 21 nt Target: | 5'-UUGUCUUCUUAAUGAUUGAAC-3' | (SEQ ID NO: 1917) |
| AAT-1469 21 nt Target: | 5'-UGUCUUCUUAAUGAUUGAACA-3' | (SEQ ID NO: 1918) |
| AAT-1470 21 nt Target: | 5'-GUCUUCUUAAUGAUUGAACAA-3' | (SEQ ID NO: 1919) |
| AAT-1471 21 nt Target: | 5'-UCUUCUUAAUGAUUGAACAAA-3' | (SEQ ID NO: 1920) |
| AAT-1472 21 nt Target: | 5'-CUUCUUAAUGAUUGAACAAAA-3' | (SEQ ID NO: 1921) |
| AAT-1473 21 nt Target: | 5'-UUCUUAAUGAUUGAACAAAAU-3' | (SEQ ID NO: 1922) |
| AAT-1474 21 nt Target: | 5'-UCUUAAUGAUUGAACAAAAUA-3' | (SEQ ID NO: 1923) |
| AAT-1475 21 nt Target: | 5'-CUUAAUGAUUGAACAAAAUAC-3' | (SEQ ID NO: 1924) |
| AAT-1476 21 nt Target: | 5'-UUAAUGAUUGAACAAAAUACC-3' | (SEQ ID NO: 1925) |
| AAT-1477 21 nt Target: | 5'-UAAUGAUUGAACAAAAUACCA-3' | (SEQ ID NO: 1926) |
| AAT-1478 21 nt Target: | 5'-AAUGAUUGAACAAAAUACCAA-3' | (SEQ ID NO: 1927) |
| AAT-1479 21 nt Target: | 5'-AUGAUUGAACAAAAUACCAAG-3' | (SEQ ID NO: 1928) |
| AAT-1480 21 nt Target: | 5'-UGAUUGAACAAAAUACCAAGU-3' | (SEQ ID NO: 1929) |
| AAT-1481 21 nt Target: | 5'-GAUUGAACAAAAUACCAAGUC-3' | (SEQ ID NO: 1930) |
| AAT-1482 21 nt Target: | 5'-AUUGAACAAAAUACCAAGUCU-3' | (SEQ ID NO: 1931) |
| AAT-1483 21 nt Target: | 5'-UUGAACAAAAUACCAAGUCUC-3' | (SEQ ID NO: 1932) |
| AAT-1484 21 nt Target: | 5'-UGAACAAAAUACCAAGUCUCC-3' | (SEQ ID NO: 1933) |
| AAT-1485 21 nt Target: | 5'-GAACAAAAUACCAAGUCUCCC-3' | (SEQ ID NO: 1934) |
| AAT-1486 21 nt Target: | 5'-AACAAAAUACCAAGUCUCCCC-3' | (SEQ ID NO: 1935) |
| AAT-1487 21 nt Target: | 5'-ACAAAAUACCAAGUCUCCCCU-3' | (SEQ ID NO: 1936) |
| AAT-1488 21 nt Target: | 5'-CAAAAUACCAAGUCUCCCCUC-3' | (SEQ ID NO: 1937) |

TABLE 10

Additional Human Anti-α-1 antitrypsin "Blunt/Blunt" DsiRNAs

| | | |
|---|---|---|
| | 5'-AAGCGUUUAGGCAUGUUUAACAUCCAG-3' | (SEQ ID NO: 1938) |
| | 3'-UUCGCAAAUCCGUACAAAUUGUAGGUC-5' | (SEQ ID NO: 1814) |
| AAT-1023 Target: | 5'-AAGCGTTTAGGCATGTTTAACATCCAG-3' | (SEQ ID NO: 1845) |
| | 5'-AGCGUUUAGGCAUGUUUAACAUCCAGC-3' | (SEQ ID NO: 1939) |
| | 3'-UCGCAAAUCCGUACAAAUUGUAGGUCG-5' | (SEQ ID NO: 1815) |
| AAT-1024 Target: | 5'-AGCGTTTAGGCATGTTTAACATCCAGC-3' | (SEQ ID NO: 1846) |

TABLE 10-continued

Additional Human Anti-α-1 antitrypsin "Blunt/Blunt" DsiRNAs

```
              5'-GGGGCCAUGUUUUUAGAGGCCAUACCC-3'   (SEQ ID NO: 1940)
              3'-CCCCGGUACAAAAAUCUCCGGUAUGGG-5'   (SEQ ID NO: 1816)
AAT-1404 Target: 5'-GGGGCCATGTTTTTAGAGGCCATACCC-3' (SEQ ID NO: 1847)

5'-AAACCCUUUGUCUUCUUAAUGAUUGAA-3'   (SEQ ID NO: 1941)
              3'-UUUGGGAAACAGAAGAAUUACUAACUU-5'   (SEQ ID NO: 1817)
AAT-1461 Target: 5'-AAACCCTTTGTCTTCTTAATGATTGAA-3' (SEQ ID NO: 1848)

5'-AACCCUUUGUCUUCUUAAUGAUUGAAC-3'   (SEQ ID NO: 1942)
              3'-UUGGGAAACAGAAGAAUUACUAACUUG-5'   (SEQ ID NO: 1818)
AAT-1462 Target: 5'-AACCCTTTGTCTTCTTAATGATTGAAC-3' (SEQ ID NO: 1849)

5'-ACCCUUUGUCUUCUUAAUGAUUGAACA-3'   (SEQ ID NO: 1943)
              3'-UGGGAAACAGAAGAAUUACUAACUUGU-5'   (SEQ ID NO: 1819)
AAT-1463 Target: 5'-ACCCTTTGTCTTCTTAATGATTGAACA-3' (SEQ ID NO: 1850)

5'-CCCUUUGUCUUCUUAAUGAUUGAACAA-3'   (SEQ ID NO: 1944)
              3'-GGGAAACAGAAGAAUUACUAACUUGUU-5'   (SEQ ID NO: 1820)
AAT-1464 Target: 5'-CCCTTTGTCTTCTTAATGATTGAACAA-3' (SEQ ID NO: 1851)

5'-CCUUUGUCUUCUUAAUGAUUGAACAAA-3'   (SEQ ID NO: 1945)
              3'-GGAAACAGAAGAAUUACUAACUUGUUU-5'   (SEQ ID NO: 1821)
AAT-1465 Target: 5'-CCTTTGTCTTCTTAATGATTGAACAAA-3' (SEQ ID NO: 1852)

5'-CUUUGUCUUCUUAAUGAUUGAACAAAA-3'   (SEQ ID NO: 1946)
              3'-GAAACAGAAGAAUUACUAACUUGUUUU-5'   (SEQ ID NO: 1822)
AAT-1466 Target: 5'-CTTTGTCTTCTTAATGATTGAACAAAA-3' (SEQ ID NO: 1853)

5'-UUUGUCUUCUUAAUGAUUGAACAAAAU-3'   (SEQ ID NO: 1947)
              3'-AAACAGAAGAAUUACUAACUUGUUUUA-5'   (SEQ ID NO: 1823)
AAT-1467 Target: 5'-TTTGTCTTCTTAATGATTGAACAAAAT-3' (SEQ ID NO: 1854)

5'-UUGUCUUCUUAAUGAUUGAACAAAAUA-3'   (SEQ ID NO: 1948)
              3'-AACAGAAGAAUUACUAACUUGUUUUAU-5'   (SEQ ID NO: 1824)
AAT-1468 Target: 5'-TTGTCTTCTTAATGATTGAACAAAATA-3' (SEQ ID NO: 1855)

5'-UGUCUUCUUAAUGAUUGAACAAAAUAC-3'   (SEQ ID NO: 1949)
              3'-ACAGAAGAAUUACUAACUUGUUUUAUG-5'   (SEQ ID NO: 1825)
AAT-1469 Target: 5'-TGTCTTCTTAATGATTGAACAAAATAC-3' (SEQ ID NO: 1856)

5'-GUCUUCUUAAUGAUUGAACAAAAUACC-3'   (SEQ ID NO: 1950)
              3'-CAGAAGAAUUACUAACUUGUUUUAUGG-5'   (SEQ ID NO: 1826)
AAT-1470 Target: 5'-GTCTTCTTAATGATTGAACAAAATACC-3' (SEQ ID NO: 1857)

5'-UCUUCUUAAUGAUUGAACAAAAUACCA-3'   (SEQ ID NO: 1951)
              3'-AGAAGAAUUACUAACUUGUUUUAUGGU-5'   (SEQ ID NO: 1827)
AAT-1471 Target: 5'-TCTTCTTAATGATTGAACAAAATACCA-3' (SEQ ID NO: 1858)

5'-CUUCUUAAUGAUUGAACAAAAUACCAA-3'   (SEQ ID NO: 1952)
              3'-GAAGAAUUACUAACUUGUUUUAUGGUU-5'   (SEQ ID NO: 1828)
AAT-1472 Target: 5'-CTTCTTAATGATTGAACAAAATACCAA-3' (SEQ ID NO: 1859)

5'-UUCUUAAUGAUUGAACAAAAUACCAAG-3'   (SEQ ID NO: 1953)
              3'-AAGAAUUACUAACUUGUUUUAUGGUUC-5'   (SEQ ID NO: 1829)
AAT-1473 Target: 5'-TTCTTAATGATTGAACAAAATACCAAG-3' (SEQ ID NO: 1860)

5'-UCUUAAUGAUUGAACAAAAUACCAAGU-3'   (SEQ ID NO: 1954)
              3'-AGAAUUACUAACUUGUUUUAUGGUUCA-5'   (SEQ ID NO: 1830)
AAT-1474 Target: 5'-TCTTAATGATTGAACAAAATACCAAGT-3' (SEQ ID NO: 1861)

5'-CUUAAUGAUUGAACAAAAUACCAAGUC-3'   (SEQ ID NO: 1955)
              3'-GAAUUACUAACUUGUUUUAUGGUUCAG-5'   (SEQ ID NO: 1831)
AAT-1475 Target: 5'-CTTAATGATTGAACAAAATACCAAGTC-3' (SEQ ID NO: 1862)

5'-UUAAUGAUUGAACAAAAUACCAAGUCU-3'   (SEQ ID NO: 1956)
              3'-AAUUACUAACUUGUUUUAUGGUUCAGA-5'   (SEQ ID NO: 1832)
AAT-1476 Target: 5'-TTAATGATTGAACAAAATACCAAGTCT-3' (SEQ ID NO: 1863)

5'-UAAUGAUUGAACAAAAUACCAAGUCUC-3'   (SEQ ID NO: 1957)
              3'-AUUACUAACUUGUUUUAUGGUUCAGAG-5'   (SEQ ID NO: 1833)
AAT-1477 Target: 5'-TAATGATTGAACAAAATACCAAGTCTC-3' (SEQ ID NO: 1864)

5'-AAUGAUUGAACAAAAUACCAAGUCUCC-3'   (SEQ ID NO: 1958)
              3'-UUACUAACUUGUUUUAUGGUUCAGAGG-5'   (SEQ ID NO: 1834)
AAT-1478 Target: 5'-AATGATTGAACAAAATACCAAGTCTCC-3' (SEQ ID NO: 1865)
```

TABLE 10-continued

Additional Human Anti-α-1 antitrypsin "Blunt/Blunt" DsiRNAs

```
              5'-AUGAUUGAACAAAAUACCAAGUCUCCC-3'    (SEQ ID NO: 1959)
              3'-UACUAACUUGUUUUAUGGUUCAGAGGG-5'    (SEQ ID NO: 1835)
AAT-1479 Target: 5'-ATGATTGAACAAAATACCAAGTCTCCC-3' (SEQ ID NO: 1866)

5'-UGAUUGAACAAAAUACCAAGUCUCCCC-3'    (SEQ ID NO: 1960)
              3'-ACUAACUUGUUUUAUGGUUCAGAGGGG-5'    (SEQ ID NO: 1836)
AAT-1480 Target: 5'-TGATTGAACAAAATACCAAGTCTCCCC-3' (SEQ ID NO: 1867)

5'-GAUUGAACAAAAUACCAAGUCUCCCCU-3'    (SEQ ID NO: 1961)
              3'-CUAACUUGUUUUAUGGUUCAGAGGGGA-5'    (SEQ ID NO: 1837)
AAT-1481 Target: 5'-GATTGAACAAAATACCAAGTCTCCCCT-3' (SEQ ID NO: 1868)

5'-AUUGAACAAAAUACCAAGUCUCCCCUC-3'    (SEQ ID NO: 1962)
              3'-UAACUUGUUUUAUGGUUCAGAGGGGAG-5'    (SEQ ID NO: 1838)
AAT-1482 Target: 5'-ATTGAACAAAATACCAAGTCTCCCCTC-3' (SEQ ID NO: 1869)

5'-UUGAACAAAAUACCAAGUCUCCCCUCU-3'    (SEQ ID NO: 1963)
              3'-AACUUGUUUUAUGGUUCAGAGGGGAGA-5'    (SEQ ID NO: 1839)
AAT-1483 Target: 5'-TTGAACAAAATACCAAGTCTCCCCTCT-3' (SEQ ID NO: 1870)

5'-UGAACAAAAUACCAAGUCUCCCCUCUU-3'    (SEQ ID NO: 1964)
              3'-ACUUGUUUUAUGGUUCAGAGGGGAGAA-5'    (SEQ ID NO: 1840)
AAT-1484 Target: 5'-TGAACAAAATACCAAGTCTCCCCTCTT-3' (SEQ ID NO: 1871)

5'-GAACAAAAUACCAAGUCUCCCCUCUUC-3'    (SEQ ID NO: 1965)
              3'-CUUGUUUUAUGGUUCAGAGGGGAGAAG-5'    (SEQ ID NO: 1841)
AAT-1485 Target: 5'-GAACAAAATACCAAGTCTCCCCTCTTC-3' (SEQ ID NO: 1872)

5'-AACAAAAUACCAAGUCUCCCCUCUUCA-3'    (SEQ ID NO: 1966)
              3'-UUGUUUUAUGGUUCAGAGGGGAGAAGU-5'    (SEQ ID NO: 1842)
AAT-1486 Target: 5'-AACAAAATACCAAGTCTCCCCTCTTCA-3' (SEQ ID NO: 1873)

5'-ACAAAAUACCAAGUCUCCCCUCUUCAU-3'    (SEQ ID NO: 1967)
              3'-UGUUUUAUGGUUCAGAGGGGAGAAGUA-5'    (SEQ ID NO: 1843)
AAT-1487 Target: 5'-ACAAAATACCAAGTCTCCCCTCTTCAT-3' (SEQ ID NO: 1874)

5'-CAAAAUACCAAGUCUCCCCUCUUCAUG-3'    (SEQ ID NO: 1968)
              3'-GUUUUAUGGUUCAGAGGGGAGAAGUAC-5'    (SEQ ID NO: 1844)
AAT-1488 Target: 5'-CAAAATACCAAGTCTCCCCTCTTCATG-3' (SEQ ID NO: 1875)
```

TABLE 11

Additional DsiRNA Component 19 Nucleotide Target Sequences in α-1 antitrypsin mRNA

```
AAT-1023 19 nt Target #1:  5'-GCGUUUAGGCAUGUUUAAC-3'  (SEQ ID NO: 1969)

AAT-1023 19 nt Target #2:  5'-AGCGUUUAGGCAUGUUUAA-3'  (SEQ ID NO: 2000)

AAT-1023 19 nt Target #3:  5'-AAGCGUUUAGGCAUGUUUA-3'  (SEQ ID NO: 2031)

AAT-1024 19 nt Target #1:  5'-CGUUUAGGCAUGUUUAACA-3'  (SEQ ID NO: 1970)

AAT-1024 19 nt Target #2:  5'-GCGUUUAGGCAUGUUUAAC-3'  (SEQ ID NO: 2001)

AAT-1024 19 nt Target #3:  5'-AGCGUUUAGGCAUGUUUAA-3'  (SEQ ID NO: 2032)

AAT-1404 19 nt Target #1:  5'-GGCCAUGUUUUUAGAGGCC-3'  (SEQ ID NO: 1971)

AAT-1404 19 nt Target #2:  5'-GGGCCAUGUUUUUAGAGGC-3'  (SEQ ID NO: 2002)

AAT-1404 19 nt Target #3:  5'-GGGGCCAUGUUUUUAGAGG-3'  (SEQ ID NO: 2033)

AAT-1461 19 nt Target #1:  5'-ACCCUUUGUCUUCUUAAUG-3'  (SEQ ID NO: 1972)

AAT-1461 19 nt Target #2:  5'-AACCCUUUGUCUUCUUAAU-3'  (SEQ ID NO: 2003)

AAT-1461 19 nt Target #3:  5'-AAACCCUUUGUCUUCUUAA-3'  (SEQ ID NO: 2034)

AAT-1462 19 nt Target #1:  5'-CCCUUUGUCUUCUUAAUGA-3'  (SEQ ID NO: 1973)

AAT-1462 19 nt Target #2:  5'-ACCCUUUGUCUUCUUAAUG-3'  (SEQ ID NO: 2004)

AAT-1462 19 nt Target #3:  5'-AACCCUUUGUCUUCUUAAU-3'  (SEQ ID NO: 2035)
```

TABLE 11-continued

Additional DsiRNA Component 19 Nucleotide Target Sequences in α-1 antitrypsin mRNA

```
AAT-1463 19 nt Target #1:   5'-CCUUUGUCUUCUUAAUGAU-3'   (SEQ ID NO: 1974)

AAT-1463 19 nt Target #2:   5'-CCCUUUGUCUUCUUAAUGA-3'   (SEQ ID NO: 2005)

AAT-1463 19 nt Target #3:   5'-ACCCUUUGUCUUCUUAAUG-3'   (SEQ ID NO: 2036)

AAT-1464 19 nt Target #1:   5'-CUUUGUCUUCUUAAUGAUU-3'   (SEQ ID NO: 1975)

AAT-1464 19 nt Target #2:   5'-CCUUUGUCUUCUUAAUGAU-3'   (SEQ ID NO: 2006)

AAT-1464 19 nt Target #3:   5'-CCCUUUGUCUUCUUAAUGA-3'   (SEQ ID NO: 2037)

AAT-1465 19 nt Target #1:   5'-UUUGUCUUCUUAAUGAUUG-3'   (SEQ ID NO: 1976)

AAT-1465 19 nt Target #2:   5'-CUUUGUCUUCUUAAUGAUU-3'   (SEQ ID NO: 2007)

AAT-1465 19 nt Target #3:   5'-CCUUUGUCUUCUUAAUGAU-3'   (SEQ ID NO: 2038)

AAT-1466 19 nt Target #1:   5'-UUGUCUUCUUAAUGAUUGA-3'   (SEQ ID NO: 1977)

AAT-1466 19 nt Target #2:   5'-UUUGUCUUCUUAAUGAUUG-3'   (SEQ ID NO: 2008)

AAT-1466 19 nt Target #3:   5'-CUUUGUCUUCUUAAUGAUU-3'   (SEQ ID NO: 2039)

AAT-1467 19 nt Target #1:   5'-UGUCUUCUUAAUGAUUGAA-3'   (SEQ ID NO: 1978)

AAT-1467 19 nt Target #2:   5'-UUGUCUUCUUAAUGAUUGA-3'   (SEQ ID NO: 2009)

AAT-1467 19 nt Target #3:   5'-UUUGUCUUCUUAAUGAUUG-3'   (SEQ ID NO: 2040)

AAT-1468 19 nt Target #1:   5'-GUCUUCUUAAUGAUUGAAC-3'   (SEQ ID NO: 1979)

AAT-1468 19 nt Target #2:   5'-UGUCUUCUUAAUGAUUGAA-3'   (SEQ ID NO: 2010)

AAT-1468 19 nt Target #3:   5'-UUGUCUUCUUAAUGAUUGA-3'   (SEQ ID NO: 2041)

AAT-1469 19 nt Target #1:   5'-UCUUCUUAAUGAUUGAACA-3'   (SEQ ID NO: 1980)

AAT-1469 19 nt Target #2:   5'-GUCUUCUUAAUGAUUGAAC-3'   (SEQ ID NO: 2011)

AAT-1469 19 nt Target #3:   5'-UGUCUUCUUAAUGAUUGAA-3'   (SEQ ID NO: 2042)

AAT-1470 19 nt Target #1:   5'-CUUCUUAAUGAUUGAACAA-3'   (SEQ ID NO: 1981)

AAT-1470 19 nt Target #2:   5'-UCUUCUUAAUGAUUGAACA-3'   (SEQ ID NO: 2012)

AAT-1470 19 nt Target #3:   5'-GUCUUCUUAAUGAUUGAAC-3'   (SEQ ID NO: 2043)

AAT-1471 19 nt Target #1:   5'-UUCUUAAUGAUUGAACAAA-3'   (SEQ ID NO: 1982)

AAT-1471 19 nt Target #2:   5'-CUUCUUAAUGAUUGAACAA-3'   (SEQ ID NO: 2013)

AAT-1471 19 nt Target #3:   5'-UCUUCUUAAUGAUUGAACA-3'   (SEQ ID NO: 2044)

AAT-1472 19 nt Target #1:   5'-UCUUAAUGAUUGAACAAAA-3'   (SEQ ID NO: 1983)

AAT-1472 19 nt Target #2:   5'-UUCUUAAUGAUUGAACAAA-3'   (SEQ ID NO: 2014)

AAT-1472 19 nt Target #3:   5'-CUUCUUAAUGAUUGAACAA-3'   (SEQ ID NO: 2045)

AAT-1473 19 nt Target #1:   5'-CUUAAUGAUUGAACAAAAU-3'   (SEQ ID NO: 1984)

AAT-1473 19 nt Target #2:   5'-UCUUAAUGAUUGAACAAAA-3'   (SEQ ID NO: 2015)

AAT-1473 19 nt Target #3:   5'-UUCUUAAUGAUUGAACAAA-3'   (SEQ ID NO: 2046)

AAT-1474 19 nt Target #1:   5'-UUAAUGAUUGAACAAAAUA-3'   (SEQ ID NO: 1985)

AAT-1474 19 nt Target #2:   5'-CUUAAUGAUUGAACAAAAU-3'   (SEQ ID NO: 2016)

AAT-1474 19 nt Target #3:   5'-UCUUAAUGAUUGAACAAAA-3'   (SEQ ID NO: 2047)

AAT-1475 19 nt Target #1:   5'-UAAUGAUUGAACAAAAUAC-3'   (SEQ ID NO: 1986)

AAT-1475 19 nt Target #2:   5'-UUAAUGAUUGAACAAAAUA-3'   (SEQ ID NO: 2017)
```

TABLE 11-continued

Additional DsiRNA Component 19 Nucleotide Target Sequences in α-1 antitrypsin mRNA

| | | |
|---|---|---|
| AAT-1475 19 nt Target #3: | 5'-CUUAAUGAUUGAACAAAAU-3' | (SEQ ID NO: 2048) |
| AAT-1476 19 nt Target #1: | 5'-AAUGAUUGAACAAAAUACC-3' | (SEQ ID NO: 1987) |
| AAT-1476 19 nt Target #2: | 5'-UAAUGAUUGAACAAAAUAC-3' | (SEQ ID NO: 2018) |
| AAT-1476 19 nt Target #3: | 5'-UUAAUGAUUGAACAAAAUA-3' | (SEQ ID NO: 2049) |
| AAT-1477 19 nt Target #1: | 5'-AUGAUUGAACAAAAUACCA-3' | (SEQ ID NO: 1988) |
| AAT-1477 19 nt Target #2: | 5'-AAUGAUUGAACAAAAUACC-3' | (SEQ ID NO: 2019) |
| AAT-1477 19 nt Target #3: | 5'-UAAUGAUUGAACAAAAUAC-3' | (SEQ ID NO: 2050) |
| AAT-1478 19 nt Target #1: | 5'-UGAUUGAACAAAAUACCAA-3' | (SEQ ID NO: 1989) |
| AAT-1478 19 nt Target #2: | 5'-AUGAUUGAACAAAAUACCA-3' | (SEQ ID NO: 2020) |
| AAT-1478 19 nt Target #3: | 5'-AAUGAUUGAACAAAAUACC-3' | (SEQ ID NO: 2051) |
| AAT-1479 19 nt Target #1: | 5'-GAUUGAACAAAAUACCAAG-3' | (SEQ ID NO: 1990) |
| AAT-1479 19 nt Target #2: | 5'-UGAUUGAACAAAAUACCAA-3' | (SEQ ID NO: 2021) |
| AAT-1479 19 nt Target #3: | 5'-AUGAUUGAACAAAAUACCA-3' | (SEQ ID NO: 2052) |
| AAT-1480 19 nt Target #1: | 5'-AUUGAACAAAAUACCAAGU-3' | (SEQ ID NO: 1991) |
| AAT-1480 19 nt Target #2: | 5'-GAUUGAACAAAAUACCAAG-3' | (SEQ ID NO: 2022) |
| AAT-1480 19 nt Target #3: | 5'-UGAUUGAACAAAAUACCAA-3' | (SEQ ID NO: 2053) |
| AAT-1481 19 nt Target #1: | 5'-UUGAACAAAAUACCAAGUC-3' | (SEQ ID NO: 1992) |
| AAT-1481 19 nt Target #2: | 5'-AUUGAACAAAAUACCAAGU-3' | (SEQ ID NO: 2023) |
| AAT-1481 19 nt Target #3: | 5'-GAUUGAACAAAAUACCAAG-3' | (SEQ ID NO: 2054) |
| AAT-1482 19 nt Target #1: | 5'-UGAACAAAAUACCAAGUCU-3' | (SEQ ID NO: 1993) |
| AAT-1482 19 nt Target #2: | 5'-UUGAACAAAAUACCAAGUC-3' | (SEQ ID NO: 2024) |
| AAT-1482 19 nt Target #3: | 5'-AUUGAACAAAAUACCAAGU-3' | (SEQ ID NO: 2055) |
| AAT-1483 19 nt Target #1: | 5'-GAACAAAAUACCAAGUCUC-3' | (SEQ ID NO: 1994) |
| AAT-1483 19 nt Target #2: | 5'-UGAACAAAAUACCAAGUCU-3' | (SEQ ID NO: 2025) |
| AAT-1483 19 nt Target #3: | 5'-UUGAACAAAAUACCAAGUC-3' | (SEQ ID NO: 2056) |
| AAT-1484 19 nt Target #1: | 5'-AACAAAAUACCAAGUCUCC-3' | (SEQ ID NO: 1995) |
| AAT-1484 19 nt Target #2: | 5'-GAACAAAAUACCAAGUCUC-3' | (SEQ ID NO: 2026) |
| AAT-1484 19 nt Target #3: | 5'-UGAACAAAAUACCAAGUCU-3' | (SEQ ID NO: 2057) |
| AAT-1485 19 nt Target #1: | 5'-ACAAAAUACCAAGUCUCCC-3' | (SEQ ID NO: 1996) |
| AAT-1485 19 nt Target #2: | 5'-AACAAAAUACCAAGUCUCC-3' | (SEQ ID NO: 2027) |
| AAT-1485 19 nt Target #3: | 5'-GAACAAAAUACCAAGUCUC-3' | (SEQ ID NO: 2058) |
| AAT-1486 19 nt Target #1: | 5'-CAAAAUACCAAGUCUCCCC-3' | (SEQ ID NO: 1997) |
| AAT-1486 19 nt Target #2: | 5'-ACAAAAUACCAAGUCUCCC-3' | (SEQ ID NO: 2028) |
| AAT-1486 19 nt Target #3: | 5'-AACAAAAUACCAAGUCUCC-3' | (SEQ ID NO: 2059) |
| AAT-1487 19 nt Target #1: | 5'-AAAAUACCAAGUCUCCCCU-3' | (SEQ ID NO: 1998) |
| AAT-1487 19 nt Target #2: | 5'-CAAAAUACCAAGUCUCCCC-3' | (SEQ ID NO: 2029) |
| AAT-1487 19 nt Target #3: | 5'-ACAAAAUACCAAGUCUCCC-3' | (SEQ ID NO: 2060) |

TABLE 11-continued

Additional DsiRNA Component 19 Nucleotide Target Sequences in α-1 antitrypsin mRNA AAT-1488 19 nt Target #1: 5'-AAAUACCAAGUCUCCCCUC-3' (SEQ ID NO: 1999)

AAT-1488 19 nt Target #2: 5'-AAAAUACCAAGUCUCCCCU-3' (SEQ ID NO: 2030)

AAT-1488 19 nt Target #3: 5'-CAAAAUACCAAGUCUCCCC-3' (SEQ ID NO: 2061)

TABLE 12

Further Human Anti-α-1 antitrypsin DsiRNA Agents (Asymmetrics)

```
              5'-CCAGGGAGAUGCUGCCCAGAAGAca-3'       (SEQ ID NO: 2062)
              3'-GGGGUCCCUCUACGACGGGUCUUCUGU-5'     (SEQ ID NO: 2202)
AAT-366 Target: 5'-CCCCAGGGAGATGCTGCCCAGAAGACA-3'   (SEQ ID NO: 2342)

5'-CAGGGAGAUGCUGCCCAGAAGACag-3'      (SEQ ID NO: 2063)
              3'-GGGUCCCUCUACGACGGGUCUUCUGUC-5'    (SEQ ID NO: 2203)
AAT-367 Target: 5'-CCCAGGGAGATGCTGCCCAGAAGACAG-3'  (SEQ ID NO: 2343)

5'-AGGGAGAUGCUGCCCAGAAGACAga-3'     (SEQ ID NO: 2064)
              3'-GGUCCCUCUACGACGGGUCUUCUGUCU-5'   (SEQ ID NO: 2204)
AAT-368 Target: 5'-CCAGGGAGATGCTGCCCAGAAGACAGA-3' (SEQ ID NO: 2344)

5'-GGGAGAUGCUGCCCAGAAGACAGat-3'    (SEQ ID NO: 2065)
              3'-GUCCCUCUACGACGGGUCUUCUGUCUA-5'  (SEQ ID NO: 2205)
AAT-369 Target: 5'-CAGGGAGATGCTGCCCAGAAGACAGAT-3' (SEQ ID NO: 2345)

5'-GGAGAUGCUGCCCAGAAGACAGAta-3'   (SEQ ID NO: 2066)
              3'-UCCCUCUACGACGGGUCUUCUGUCUAU-5' (SEQ ID NO: 2206)
AAT-370 Target: 5'-AGGGAGATGCTGCCCAGAAGACAGATA-3' (SEQ ID NO: 2346)

5'-GAGAUGCUGCCCAGAAGACAGAUac-3'  (SEQ ID NO: 2067)
              3'-CCCUCUACGACGGGUCUUCUGUCUAUG-5' (SEQ ID NO: 2207)
AAT-371 Target: 5'-GGGAGATGCTGCCCAGAAGACAGATAC-3' (SEQ ID NO: 2347)

5'-GAUACAUCCCACCAUGAUCAGGAUc-3'  (SEQ ID NO: 2068)
              3'-GUCUAUGUAGGGUGGUACUAGUCCUAG-5' (SEQ ID NO: 2208)
AAT-391 Target: 5'-CAGATACATCCCACCATGATCAGGATC-3' (SEQ ID NO: 2348)

5'-AUACAUCCCACCAUGAUCAGGAUca-3'  (SEQ ID NO: 2069)
              3'-UCUAUGUAGGGUGGUACUAGUCCUAGU-5' (SEQ ID NO: 2209)
AAT-392 Target: 5'-AGATACATCCCACCATGATCAGGATCA-3' (SEQ ID NO: 2349)

5'-UACAUCCCACCAUGAUCAGGAUCac-3'  (SEQ ID NO: 2070)
              3'-CUAUGUAGGGUGGUACUAGUCCUAGUG-5' (SEQ ID NO: 2210)
AAT-393 Target: 5'-GATACATCCCACCATGATCAGGATCAC-3' (SEQ ID NO: 2350)

5'-ACAUCCCACCAUGAUCAGGAUCAcc-3'  (SEQ ID NO: 2071)
              3'-UAUGUAGGGUGGUACUAGUCCUAGUGG-5' (SEQ ID NO: 2211)
AAT-394 Target: 5'-ATACATCCCACCATGATCAGGATCACC-3' (SEQ ID NO: 2351)

5'-ACCAGUCCAACAGCACCAAUAUCtt-3'  (SEQ ID NO: 2072)
              3'-UGUGGUCAGGUUGUCGUGGUUAUAGAA-5' (SEQ ID NO: 2212)
AAT-485 Target: 5'-ACACCAGTCCAACAGCACCAATATCTT-3' (SEQ ID NO: 2352)

5'-CCAGUCCAACAGCACCAAUAUCUtc-3'  (SEQ ID NO: 2073)
              3'-GUGGUCAGGUUGUCGUGGUUAUAGAAG-5' (SEQ ID NO: 2213)
AAT-486 Target: 5'-CACCAGTCCAACAGCACCAATATCTTC-3' (SEQ ID NO: 2353)

5'-CAGUCCAACAGCACCAAUAUCUUct-3' (SEQ ID NO: 2074)
              3'-UGGUCAGGUUGUCGUGGUUAUAGAAGA-5' (SEQ ID NO: 2214)
AAT-487 Target: 5'-ACCAGTCCAACAGCACCAATATCTTCT-3' (SEQ ID NO: 2354)

5'-AGUCCAACAGCACCAAUAUCUUCtt-3' (SEQ ID NO: 2075)
              3'-GGUCAGGUUGUCGUGGUUAUAGAAGAA-5' (SEQ ID NO: 2215)
AAT-488 Target: 5'-CCAGTCCAACAGCACCAATATCTTCTT-3' (SEQ ID NO: 2355)

5'-GUCCAACAGCACCAAUAUCUUCUtc-3' (SEQ ID NO: 2076)
              3'-GUCAGGUUGUCGUGGUUAUAGAAGAAG-5' (SEQ ID NO: 2216)
AAT-489 Target: 5'-CAGTCCAACAGCACCAATATCTTCTTC-3' (SEQ ID NO: 2356)

5'-UCCAACAGCACCAAUAUCUUCUUct-3' (SEQ ID NO: 2077)
              3'-UCAGGUUGUCGUGGUUAUAGAAGAAGA-5' (SEQ ID NO: 2217)
AAT-490 Target: 5'-AGTCCAACAGCACCAATATCTTCTTCT-3' (SEQ ID NO: 2357)
```

TABLE 12-continued

Further Human Anti-α-1 antitrypsin DsiRNA Agents (Asymmetrics)

```
                5'-CCAACAGCACCAAUAUCUUCUUCUtc-3'      (SEQ ID NO: 2078)
                3'-CAGGUUGUCGUGGUUAUAGAAGAAGAG-5'     (SEQ ID NO: 2218)
AAT-491 Target: 5'-GTCCAACAGCACCAATATCTTCTTCTC-3'     (SEQ ID NO: 2358)

5'-CAACAGCACCAAUAUCUUCUUCUCc-3'       (SEQ ID NO: 2079)
                3'-AGGUUGUCGUGGUUAUAGAAGAAGAGG-5'     (SEQ ID NO: 2219)
AAT-492 Target: 5'-TCCAACAGCACCAATATCTTCTTCTCC-3'     (SEQ ID NO: 2359)

5'-AACAGCACCAAUAUCUUCUUCUCcc-3'       (SEQ ID NO: 2080)
                3'-GGUUGUCGUGGUUAUAGAAGAAGAGGG-5'     (SEQ ID NO: 2220)
AAT-493 Target: 5'-CCAACAGCACCAATATCTTCTTCTCCC-3'    (SEQ ID NO: 2360)

5'-ACAGCACCAAUAUCUUCUUCUCCcc-3'       (SEQ ID NO: 2081)
                3'-GUUGUCGUGGUUAUAGAAGAAGAGGGG-5'     (SEQ ID NO: 2221)
AAT-494 Target: 5'-CAACAGCACCAATATCTTCTTCTCCCC-3'    (SEQ ID NO: 2361)

5'-CAGCACCAAUAUCUUCUUCUCCCca-3'       (SEQ ID NO: 2082)
                3'-UUGUCGUGGUUAUAGAAGAAGAGGGGU-5'     (SEQ ID NO: 2222)
AAT-495 Target: 5'-AACAGCACCAATATCTTCTTCTCCCCA-3'    (SEQ ID NO: 2362)

5'-AGCACCAAUAUCUUCUUCUCCCCag-3'       (SEQ ID NO: 2083)
                3'-UGUCGUGGUUAUAGAAGAAGAGGGGUC-5'     (SEQ ID NO: 2223)
AAT-496 Target: 5'-ACAGCACCAATATCTTCTTCTCCCCAG-3'    (SEQ ID NO: 2363)

5'-GCACCAAUAUCUUCUUCUCCCCAgt-3'       (SEQ ID NO: 2084)
                3'-GUCGUGGUUAUAGAAGAAGAGGGGUCA-5'     (SEQ ID NO: 2224)
AAT-497 Target: 5'-CAGCACCAATATCTTCTTCTCCCCAGT-3'    (SEQ ID NO: 2364)

5'-CACCAAUAUCUUCUUCUCCCCAGtg-3'       (SEQ ID NO: 2085)
                3'-UCGUGGUUAUAGAAGAAGAGGGGUCAC-5'     (SEQ ID NO: 2225)
AAT-498 Target: 5'-AGCACCAATATCTTCTTCTCCCCAGTG-3'    (SEQ ID NO: 2365)

5'-ACCAAUAUCUUCUUCUCCCCAGUga-3'       (SEQ ID NO: 2086)
                3'-CGUGGUUAUAGAAGAAGAGGGGUCACU-5'     (SEQ ID NO: 2226)
AAT-499 Target: 5'-GCACCAATATCTTCTTCTCCCCAGTGA-3'    (SEQ ID NO: 2366)

5'-CCCAGUGAGCAUCGCUACAGCCUtt-3'       (SEQ ID NO: 2087)
                3'-AGGGGUCACUCGUAGCGAUGUCGGAAA-5'     (SEQ ID NO: 2227)
AAT-516 Target: 5'-TCCCCAGTGAGCATCGCTACAGCCTTT-3'    (SEQ ID NO: 2367)

5'-CCAGUGAGCAUCGCUACAGCCUUtg-3'       (SEQ ID NO: 2088)
                3'-GGGGUCACUCGUAGCGAUGUCGGAAAC-5'     (SEQ ID NO: 2228)
AAT-517 Target: 5'-CCCCAGTGAGCATCGCTACAGCCTTTG-3'    (SEQ ID NO: 2368)

5'-CAGUGAGCAUCGCUACAGCCUUUgc-3'       (SEQ ID NO: 2089)
                3'-GGGUCACUCGUAGCGAUGUCGGAAACG-5'     (SEQ ID NO: 2229)
AAT-518 Target: 5'-CCCAGTGAGCATCGCTACAGCCTTTGC-3'    (SEQ ID NO: 2369)

5'-AGUGAGCAUCGCUACAGCCUUUGca-3'       (SEQ ID NO: 2090)
                3'-GGUCACUCGUAGCGAUGUCGGAAACGU-5'     (SEQ ID NO: 2230)
AAT-519 Target: 5'-CCAGTGAGCATCGCTACAGCCTTTGCA-3'    (SEQ ID NO: 2370)

5'-GUGAGCAUCGCUACAGCCUUUGCaa-3'       (SEQ ID NO: 2091)
                3'-GUCACUCGUAGCGAUGUCGGAAACGUU-5'     (SEQ ID NO: 2231)
AAT-520 Target: 5'-CAGTGAGCATCGCTACAGCCTTTGCAA-3'    (SEQ ID NO: 2371)

5'-UGAGCAUCGCUACAGCCUUUGCAat-3'       (SEQ ID NO: 2092)
                3'-UCACUCGUAGCGAUGUCGGAAACGUUA-5'     (SEQ ID NO: 2232)
AAT-521 Target: 5'-AGTGAGCATCGCTACAGCCTTTGCAAT-3'    (SEQ ID NO: 2372)

5'-GAGCAUCGCUACAGCCUUUGCAatg-3'       (SEQ ID NO: 2093)
                3'-CACUCGUAGCGAUGUCGGAAACGUUAC-5'     (SEQ ID NO: 2233)
AAT-522 Target: 5'-GTGAGCATCGCTACAGCCTTTGCAATG-3'    (SEQ ID NO: 2373)

5'-AGCAUCGCUACAGCCUUUGCAAUgc-3'       (SEQ ID NO: 2094)
                3'-ACUCGUAGCGAUGUCGGAAACGUUACG-5'     (SEQ ID NO: 2234)
AAT-523 Target: 5'-TGAGCATCGCTACAGCCTTTGCAATGC-3'    (SEQ ID NO: 2374)

5'-GCAUCGCUACAGCCUUUGCAAUGct-3'       (SEQ ID NO: 2095)
                3'-CUCGUAGCGAUGUCGGAAACGUUACGA-5'     (SEQ ID NO: 2235)
AAT-524 Target: 5'-GAGCATCGCTACAGCCTTTGCAATGCT-3'    (SEQ ID NO: 2375)

5'-CAUCGCUACAGCCUUUGCAAUGCtc-3'       (SEQ ID NO: 2096)
                3'-UCGUAGCGAUGUCGGAAACGUUACGAG-5'     (SEQ ID NO: 2236)
AAT-525 Target: 5'-AGCATCGCTACAGCCTTTGCAATGCTC-3'    (SEQ ID NO: 2376)
```

TABLE 12-continued

Further Human Anti-α-1 antitrypsin DsiRNA Agents (Asymmetrics)

```
                5'-AUCGCUACAGCCUUUGCAAUGCUct-3'        (SEQ ID NO: 2097)
                3'-CGUAGCGAUGUCGGAAACGUUACGAGA-5'      (SEQ ID NO: 2237)
AAT-526 Target: 5'-GCATCGCTACAGCCTTTGCAATGCTCT-3'      (SEQ ID NO: 2377)

5'-UCGCUACAGCCUUUGCAAUGCUCtc-3'        (SEQ ID NO: 2098)
                3'-GUAGCGAUGUCGGAAACGUUACGAGAG-5'      (SEQ ID NO: 2238)
AAT-527 Target: 5'-CATCGCTACAGCCTTTGCAATGCTCTC-3'      (SEQ ID NO: 2378)

5'-CGCUACAGCCUUUGCAAUGCUCUcc-3'        (SEQ ID NO: 2099)
                3'-UAGCGAUGUCGGAAACGUUACGAGAGG-5'      (SEQ ID NO: 2239)
AAT-528 Target: 5'-ATCGCTACAGCCTTTGCAATGCTCTCC-3'      (SEQ ID NO: 2379)

5'-GCUACAGCCUUUGCAAUGCUCUCcc-3'        (SEQ ID NO: 2100)
                3'-AGCGAUGUCGGAAACGUUACGAGAGGG-5'      (SEQ ID NO: 2240)
AAT-529 Target: 5'-TCGCTACAGCCTTTGCAATGCTCTCCC-3'      (SEQ ID NO: 2380)

5'-CUACAGCCUUUGCAAUGCUCUCCct-3'        (SEQ ID NO: 2101)
                3'-GCGAUGUCGGAAACGUUACGAGAGGGA-5'      (SEQ ID NO: 2241)
AAT-530 Target: 5'-CGCTACAGCCTTTGCAATGCTCTCCCT-3'      (SEQ ID NO: 2381)

5'-UACAGCCUUUGCAAUGCUCUCCCtg-3'        (SEQ ID NO: 2102)
                3'-CGAUGUCGGAAACGUUACGAGAGGGAC-5'      (SEQ ID NO: 2242)
AAT-531 Target: 5'-GCTACAGCCTTTGCAATGCTCTCCCTG-3'      (SEQ ID NO: 2382)

5'-CCUGGGGACCAAGGCUGACACUCac-3'        (SEQ ID NO: 2103)
                3'-AGGGACCCCUGGUUCCGACUGUGAGUG-5'      (SEQ ID NO: 2243)
AAT-552 Target: 5'-TCCCTGGGGACCAAGGCTGACACTCAC-3'      (SEQ ID NO: 2383)

5'-GGGACCAAGGCUGACACUCACGAtg-3'        (SEQ ID NO: 2104)
                3'-ACCCCUGGUUCCGACUGUGAGUGCUAC-5'      (SEQ ID NO: 2244)
AAT-556 Target: 5'-TGGGGACCAAGGCTGACACTCACGATG-3'      (SEQ ID NO: 2384)

5'-GGACCAAGGCUGACACUCACGAUga-3'        (SEQ ID NO: 2105)
                3'-CCCCUGGUUCCGACUGUGAGUGCUACU-5'      (SEQ ID NO: 2245)
AAT-557 Target: 5'-GGGGACCAAGGCTGACACTCACGATGA-3'      (SEQ ID NO: 2385)

5'-GACCAAGGCUGACACUCACGAUGaa-3'        (SEQ ID NO: 2106)
                3'-CCCUGGUUCCGACUGUGAGUGCUACUU-5'      (SEQ ID NO: 2246)
AAT-558 Target: 5'-GGGACCAAGGCTGACACTCACGATGAA-3'      (SEQ ID NO: 2386)

5'-UGAAAUCCUGGAGGGCCUGAAUUtc-3'        (SEQ ID NO: 2107)
                3'-CUACUUUAGGACCUCCCGGACUUAAAG-5'      (SEQ ID NO: 2247)
AAT-579 Target: 5'-GATGAAATCCTGGAGGGCCTGAATTTC-3'      (SEQ ID NO: 2387)

5'-GAAAUCCUGGAGGGCCUGAUUUca-3'         (SEQ ID NO: 2108)
                3'-UACUUUAGGACCUCCCGGACUUAAAGU-5'      (SEQ ID NO: 2248)
AAT-580 Target: 5'-ATGAAATCCTGGAGGGCCTGAATTTCA-3'      (SEQ ID NO: 2388)

5'-UCCAUGAAGGCUUCCAGGAACUCct-3'        (SEQ ID NO: 2109)
                3'-CUAGGUACUUCCGAAGGUCCUUGAGGA-5'      (SEQ ID NO: 2249)
AAT-632 Target: 5'-GATCCATGAAGGCTTCCAGGAACTCCT-3'      (SEQ ID NO: 2389)

5'-CCAUGAAGGCUUCCAGGAACUCCtc-3'        (SEQ ID NO: 2110)
                3'-UAGGUACUUCCGAAGGUCCUUGAGGAG-5'      (SEQ ID NO: 2250)
AAT-633 Target: 5'-ATCCATGAAGGCTTCCAGGAACTCCTC-3'      (SEQ ID NO: 2390)

5'-GGACACCGAAGAGGCCAAGAAACag-3'        (SEQ ID NO: 2111)
                3'-CCCCUGUGGCUUCUCCGGUUCUUUGUC-5'      (SEQ ID NO: 2251)
AAT-801 Target: 5'-GGGGACACCGAAGAGGCCAAGAAACAG-3'      (SEQ ID NO: 2391)

5'-GACACCGAAGAGGCCAAGAAACAga-3'        (SEQ ID NO: 2112)
                3'-CCCUGUGGCUUCUCCGGUUCUUUGUCU-5'      (SEQ ID NO: 2252)
AAT-802 Target: 5'-GGGACACCGAAGAGGCCAAGAAACAGA-3'      (SEQ ID NO: 2392)

5'-ACACCGAAGAGGCCAAGAAACAGat-3'        (SEQ ID NO: 2113)
                3'-CCUGUGGCUUCUCCGGUUCUUUGUCUA-5'      (SEQ ID NO: 2253)
AAT-803 Target: 5'-GGACACCGAAGAGGCCAAGAAACAGAT-3'      (SEQ ID NO: 2393)

5'-CACCGAAGAGGCCAAGAAACAGAtc-3'        (SEQ ID NO: 2114)
                3'-CUGUGGCUUCUCCGGUUCUUUGUCUAG-5'      (SEQ ID NO: 2254)
AAT-804 Target: 5'-GACACCGAAGAGGCCAAGAAACAGATC-3'      (SEQ ID NO: 2394)

5'-ACCGAAGAGGCCAAGAAACAGAUca-3'        (SEQ ID NO: 2115)
                3'-UGUGGCUUCUCCGGUUCUUUGUCUAGU-5'      (SEQ ID NO: 2255)
AAT-805 Target: 5'-ACACCGAAGAGGCCAAGAAACAGATCA-3'      (SEQ ID NO: 2395)
```

TABLE 12-continued

Further Human Anti-α-1 antitrypsin DsiRNA Agents (Asymmetrics)

| | | |
|---|---|---|
| | 5'-CCGAAGAGGCCAAGAAACAGAUCaa-3' | (SEQ ID NO: 2116) |
| | 3'-GUGGCUUCUCCGGUUCUUUGUCUAGUU-5' | (SEQ ID NO: 2256) |
| AAT-806 Target: | 5'-CACCGAAGAGGCCAAGAAACAGATCAA-3' | (SEQ ID NO: 2396) |
| | 5'-CGAAGAGGCCAAGAAACAGAUCAac-3' | (SEQ ID NO: 2117) |
| | 3'-UGGCUUCUCCGGUUCUUUGUCUAGUUG-5' | (SEQ ID NO: 2257) |
| AAT-807 Target: | 5'-ACCGAAGAGGCCAAGAAACAGATCAAC-3' | (SEQ ID NO: 2397) |
| | 5'-GAAGAGGCCAAGAAACAGAUCAAcg-3' | (SEQ ID NO: 2118) |
| | 3'-GGCUUCUCCGGUUCUUUGUCUAGUUGC-5' | (SEQ ID NO: 2258) |
| AAT-808 Target: | 5'-CCGAAGAGGCCAAGAAACAGATCAACG-3' | (SEQ ID NO: 2398) |
| | 5'-AAGAGGCCAAGAAACAGAUCAACga-3' | (SEQ ID NO: 2119) |
| | 3'-GCUUCUCCGGUUCUUUGUCUAGUUGCU-5' | (SEQ ID NO: 2259) |
| AAT-809 Target: | 5'-CGAAGAGGCCAAGAAACAGATCAACGA-3' | (SEQ ID NO: 2399) |
| | 5'-AGAGGCCAAGAAACAGAUCAACGat-3' | (SEQ ID NO: 2120) |
| | 3'-CUUCUCCGGUUCUUUGUCUAGUUGCUA-5' | (SEQ ID NO: 2260) |
| AAT-810 Target: | 5'-GAAGAGGCCAAGAAACAGATCAACGAT-3' | (SEQ ID NO: 2400) |
| | 5'-GAGGCCAAGAAACAGAUCAACGAtt-3' | (SEQ ID NO: 2121) |
| | 3'-UUCUCCGGUUCUUUGUCUAGUUGCUAA-5' | (SEQ ID NO: 2261) |
| AAT-811 Target: | 5'-AAGAGGCCAAGAAACAGATCAACGATT-3' | (SEQ ID NO: 2401) |
| | 5'-AGGCCAAGAAACAGAUCAACGAUta-3' | (SEQ ID NO: 2122) |
| | 3'-UCUCCGGUUCUUUGUCUAGUUGCUAAU-5' | (SEQ ID NO: 2262) |
| AAT-812 Target: | 5'-AGAGGCCAAGAAACAGATCAACGATTA-3' | (SEQ ID NO: 2402) |
| | 5'-GGCCAAGAAACAGAUCAACGAUUac-3' | (SEQ ID NO: 2123) |
| | 3'-CUCCGGUUCUUUGUCUAGUUGCUAAUG-5' | (SEQ ID NO: 2263) |
| AAT-813 Target: | 5'-GAGGCCAAGAAACAGATCAACGATTAC-3' | (SEQ ID NO: 2403) |
| | 5'-UUUUGCUCUGGUGAAUUACAUCUtc-3' | (SEQ ID NO: 2124) |
| | 3'-CAAAAACGAGACCACUUAAUGUAGAAG-5' | (SEQ ID NO: 2264) |
| AAT-900 Target: | 5'-GTTTTGCTCTGGTGAATTACATCTTC-3' | (SEQ ID NO: 2404) |
| | 5'-UUUGCUCUGGUGAAUUACAUCUUct-3' | (SEQ ID NO: 2125) |
| | 3'-AAAAACGAGACCACUUAAUGUAGAAGA-5' | (SEQ ID NO: 2265) |
| AAT-901 Target: | 5'-TTTTTGCTCTGGTGAATTACATCTTCT-3' | (SEQ ID NO: 2405) |
| | 5'-UUGCUCUGGUGAAUUACAUCUUCtt-3' | (SEQ ID NO: 2126) |
| | 3'-AAAACGAGACCACUUAAUGUAGAAGAA-5' | (SEQ ID NO: 2266) |
| AAT-902 Target: | 5'-TTTTGCTCTGGTGAATTACATCTTCTT-3' | (SEQ ID NO: 2406) |
| | 5'-UGCUCUGGUGAAUUACAUCUUCUtt-3' | (SEQ ID NO: 2127) |
| | 3'-AAACGAGACCACUUAAUGUAGAAGAAA-5' | (SEQ ID NO: 2267) |
| AAT-903 Target: | 5'-TTTGCTCTGGTGAATTACATCTTCTTT-3' | (SEQ ID NO: 2407) |
| | 5'-GCUCUGGUGAAUUACAUCUUCUUta-3' | (SEQ ID NO: 2128) |
| | 3'-AACGAGACCACUUAAUGUAGAAGAAAU-5' | (SEQ ID NO: 2268) |
| AAT-904 Target: | 5'-TTGCTCTGGTGAATTACATCTTCTTTA-3' | (SEQ ID NO: 2408) |
| | 5'-CUCUGGUGAAUUACAUCUUCUUUaa-3' | (SEQ ID NO: 2129) |
| | 3'-ACGAGACCACUUAAUGUAGAAGAAAUU-5' | (SEQ ID NO: 2269) |
| AAT-905 Target: | 5'-TGCTCTGGTGAATTACATCTTCTTTAA-3' | (SEQ ID NO: 2409) |
| | 5'-UCUGGUGAAUUACAUCUUCUUUAaa-3' | (SEQ ID NO: 2130) |
| | 3'-CGAGACCACUUAAUGUAGAAGAAAUUU-5' | (SEQ ID NO: 2270) |
| AAT-906 Target: | 5'-GCTCTGGTGAATTACATCTTCTTTAAA-3' | (SEQ ID NO: 2410) |
| | 5'-CUGGUGAAUUACAUCUUCUUUAAag-3' | (SEQ ID NO: 2131) |
| | 3'-GAGACCACUUAAUGUAGAAGAAAUUUC-5' | (SEQ ID NO: 2271) |
| AAT-907 Target: | 5'-CTCTGGTGAATTACATCTTCTTTAAAG-3' | (SEQ ID NO: 2411) |
| | 5'-UGGUGAAUUACAUCUUCUUUAAAgg-3' | (SEQ ID NO: 2132) |
| | 3'-AGACCACUUAAUGUAGAAGAAAUUUCC-5' | (SEQ ID NO: 2272) |
| AAT-908 Target: | 5'-TCTGGTGAATTACATCTTCTTTAAAGG-3' | (SEQ ID NO: 2412) |
| | 5'-GGUGAAUUACAUCUUCUUUAAAGgc-3' | (SEQ ID NO: 2133) |
| | 3'-GACCACUUAAUGUAGAAGAAAUUUCCG-5' | (SEQ ID NO: 2273) |
| AAT-909 Target: | 5'-CTGGTGAATTACATCTTCTTTAAAGGC-3' | (SEQ ID NO: 2413) |
| | 5'-GUGAAUUACAUCUUCUUUAAAGGca-3' | (SEQ ID NO: 2134) |
| | 3'-ACCACUUAAUGUAGAAGAAAUUUCCGU-5' | (SEQ ID NO: 2274) |
| AAT-910 Target: | 5'-TGGTGAATTACATCTTCTTTAAAGGCA-3' | (SEQ ID NO: 2414) |

TABLE 12-continued

Further Human Anti-α-1 antitrypsin DsiRNA Agents (Asymmetrics)

```
                5'-UGAAUUACAUCUUCUUUAAAGGCaa-3'       (SEQ ID NO: 2135)
                3'-CCACUUAAUGUAGAAGAAAUUUCCGUU-5'     (SEQ ID NO: 2275)
AAT-911 Target: 5'-GGTGAATTACATCTTCTTTAAAGGCAA-3'    (SEQ ID NO: 2415)

5'-GAAUUACAUCUUCUUUAAAGGCAaa-3'       (SEQ ID NO: 2136)
                3'-CACUUAAUGUAGAAGAAAUUUCCGUUU-5'    (SEQ ID NO: 2276)
AAT-912 Target: 5'-GTGAATTACATCTTCTTTAAAGGCAAA-3'    (SEQ ID NO: 2416)

5'-AAUUACAUCUUCUUUAAAGGCAAat-3'      (SEQ ID NO: 2137)
                3'-ACUUAAUGUAGAAGAAAUUUCCGUUUA-5'    (SEQ ID NO: 2277)
AAT-913 Target: 5'-TGAATTACATCTTCTTTAAAGGCAAAT-3'    (SEQ ID NO: 2417)

5'-AUUACAUCUUCUUUAAAGGCAAAtg-3'      (SEQ ID NO: 2138)
                3'-CUUAAUGUAGAAGAAAUUUCCGUUUAC-5'    (SEQ ID NO: 2278)
AAT-914 Target: 5'-GAATTACATCTTCTTTAAAGGCAAATG-3'    (SEQ ID NO: 2418)

5'-UUACAUCUUCUUUAAAGGCAAAUGG-3'      (SEQ ID NO: 2139)
                3'-UUAAUGUAGAAGAAAUUUCCGUUUACC-5'    (SEQ ID NO: 2279)
AAT-915 Target: 5'-AATTACATCTTCTTTAAAGGCAAATGG-3'    (SEQ ID NO: 2419)

5'-UACAUCUUCUUUAAAGGCAAAUGgg-3'      (SEQ ID NO: 2140)
                3'-UAAUGUAGAAGAAAUUUCCGUUUACCC-5'    (SEQ ID NO: 2280)
AAT-916 Target: 5'-ATTACATCTTCTTTAAAGGCAAATGGG-3'    (SEQ ID NO: 2420)

5'-ACAUCUUCUUUAAAGGCAAAUGGga-3'      (SEQ ID NO: 2141)
                3'-AAUGUAGAAGAAAUUUCCGUUUACCCU-5'    (SEQ ID NO: 2281)
AAT-917 Target: 5'-TTACATCTTCTTTAAAGGCAAATGGGA-3'    (SEQ ID NO: 2421)

5'-CAUCUUCUUUAAAGGCAAAUGGGag-3'      (SEQ ID NO: 2142)
                3'-AUGUAGAAGAAAUUUCCGUUUACCCUC-5'    (SEQ ID NO: 2282)
AAT-918 Target: 5'-TACATCTTCTTTAAAGGCAAATGGGAG-3'    (SEQ ID NO: 2422)

5'-UUCUUUAAAGGCAAAUGGGAGAGac-3'      (SEQ ID NO: 2143)
                3'-AGAAGAAAUUUCCGUUUACCCUCUCUG-5'    (SEQ ID NO: 2283)
AAT-922 Target: 5'-TCTTCTTTAAAGGCAAATGGGAGAGAC-3'    (SEQ ID NO: 2423)

5'-CUUUAAAGGCAAAUGGGAGAGACcc-3'      (SEQ ID NO: 2144)
                3'-AAGAAAUUUCCGUUUACCCUCUCUGGG-5'    (SEQ ID NO: 2284)
AAT-924 Target: 5'-TTCTTTAAAGGCAAATGGGAGAGACCC-3'    (SEQ ID NO: 2424)

5'-GCAAAUGGGAGAGACCCUUUGAAgt-3'      (SEQ ID NO: 2145)
                3'-UCCGUUUACCCUCUCUGGGAAACUUCA-5'    (SEQ ID NO: 2285)
AAT-932 Target: 5'-AGGCAAATGGGAGAGACCCTTTGAAGT-3'    (SEQ ID NO: 2425)

5'-CAAAUGGGAGAGACCCUUUGAAGtc-3'      (SEQ ID NO: 2146)
                3'-CCGUUUACCCUCUCUGGGAAACUUCAG-5'    (SEQ ID NO: 2286)
AAT-933 Target: 5'-GGCAAATGGGAGAGACCCTTTGAAGTC-3'    (SEQ ID NO: 2426)

5'-AAAUGGGAGAGACCCUUUGAAGUca-3'      (SEQ ID NO: 2147)
                3'-CGUUUACCCUCUCUGGGAAACUUCAGU-5'    (SEQ ID NO: 2287)
AAT-934 Target: 5'-GCAAATGGGAGAGACCCTTTGAAGTCA-3'    (SEQ ID NO: 2427)

5'-AAUGGGAGAGACCCUUUGAAGUCaa-3'      (SEQ ID NO: 2148)
                3'-GUUUACCCUCUCUGGGAAACUUCAGUU-5'    (SEQ ID NO: 2288)
AAT-935 Target: 5'-CAAATGGGAGAGACCCTTTGAAGTCAA-3'    (SEQ ID NO: 2428)

5'-UGUCCAGCUGGGUGCUGCUGAUGaa-3'      (SEQ ID NO: 2149)
                3'-CGACAGGUCGACCCACGACGACUACUU-5'    (SEQ ID NO: 2289)
AAT-1061 Target:5'-GCTGTCCAGCTGGGTGCTGCTGATGAA-3'    (SEQ ID NO: 2429)

5'-GUCCAGCUGGGUGCUGCUGAUGAaa-3'      (SEQ ID NO: 2150)
                3'-GACAGGUCGACCCACGACGACUACUUU-5'    (SEQ ID NO: 2290)
AAT-1062 Target:5'-CTGTCCAGCTGGGTGCTGCTGATGAAA-3'    (SEQ ID NO: 2430)

5'-UCCAGCUGGGUGCUGCUGAUGAAat-3'      (SEQ ID NO: 2151)
                3'-ACAGGUCGACCCACGACGACUACUUUA-5'    (SEQ ID NO: 2291)
AAT-1063 Target:5'-TGTCCAGCTGGGTGCTGCTGATGAAAT-3'    (SEQ ID NO: 2431)

5'-CCAGCUGGGUGCUGCUGAUGAAAta-3'      (SEQ ID NO: 2152)
                3'-CAGGUCGACCCACGACGACUACUUUAU-5'    (SEQ ID NO: 2292)
AAT-1064 Target:5'-GTCCAGCTGGGTGCTGCTGATGAAATA-3'    (SEQ ID NO: 2432)

5'-CAGCUGGGUGCUGCUGAUGAAAUac-3'      (SEQ ID NO: 2153)
                3'-AGGUCGACCCACGACGACUACUUUAUG-5'    (SEQ ID NO: 2293)
AAT-1065 Target:5'-TCCAGCTGGGTGCTGCTGATGAAATAC-3'    (SEQ ID NO: 2433)
```

TABLE 12-continued

Further Human Anti-α-1 antitrypsin DsiRNA Agents (Asymmetrics)

```
            5'-AGCUGGGUGCUGCUGAUGAAAUAcc-3'     (SEQ ID NO: 2154)
            3'-GGUCGACCCACGACGACUACUUUAUGG-5'   (SEQ ID NO: 2294)
AAT-1066 Target: 5'-CCAGCTGGGTGCTGCTGATGAAATACC-3'  (SEQ ID NO: 2434)

5'-GCUGGGUGCUGCUGAUGAAAUACct-3'     (SEQ ID NO: 2155)
            3'-GUCGACCCACGACGACUACUUUAUGGA-5'   (SEQ ID NO: 2295)
AAT-1067 Target: 5'-CAGCTGGGTGCTGCTGATGAAATACCT-3' (SEQ ID NO: 2435)

5'-CUGGGUGCUGCUGAUGAAAUACCtg-3'     (SEQ ID NO: 2156)
            3'-UCGACCCACGACGACUACUUUAUGGAC-5'   (SEQ ID NO: 2296)
AAT-1068 Target: 5'-AGCTGGGTGCTGCTGATGAAATACCTG-3' (SEQ ID NO: 2436)

5'-UGGGUGCUGCUGAUGAAAUACCUgg-3'     (SEQ ID NO: 2157)
            3'-CGACCCACGACGACUACUUUAUGGACC-5'   (SEQ ID NO: 2297)
AAT-1069 Target: 5'-GCTGGGTGCTGCTGATGAAATACCTGG-3' (SEQ ID NO: 2437)

5'-GGGUGCUGCUGAUGAAAUACCUGgg-3'     (SEQ ID NO: 2158)
            3'-GACCCACGACGACUACUUUAUGGACCC-5'   (SEQ ID NO: 2298)
AAT-1070 Target: 5'-CTGGGTGCTGCTGATGAAATACCTGGG-3' (SEQ ID NO: 2438)

5'-GUGCUGCUGAUGAAAUACCUGGGca-3'     (SEQ ID NO: 2159)
            3'-CCCACGACGACUACUUUAUGGACCCGU-5'   (SEQ ID NO: 2299)
AAT-1072 Target: 5'-GGGTGCTGCTGATGAAATACCTGGGCA-3' (SEQ ID NO: 2439)

5'-UGCUGCUGAUGAAAUACCUGGGCaa-3'     (SEQ ID NO: 2160)
            3'-CCACGACGACUACUUUAUGGACCCGUU-5'   (SEQ ID NO: 2300)
AAT-1073 Target: 5'-GGTGCTGCTGATGAAATACCTGGGCAA-3' (SEQ ID NO: 2440)

5'-GCUGCUGAUGAAAUACCUGGGCAat-3'     (SEQ ID NO: 2161)
            3'-CACGACGACUACUUUAUGGACCCGUUA-5'   (SEQ ID NO: 2301)
AAT-1074 Target: 5'-GTGCTGCTGATGAAATACCTGGGCAAT-3' (SEQ ID NO: 2441)

5'-CUGCUGAUGAAAUACCUGGGCAAtg-3'     (SEQ ID NO: 2162)
            3'-ACGACGACUACUUUAUGGACCCGUUAC-5'   (SEQ ID NO: 2302)
AAT-1075 Target: 5'-TGCTGCTGATGAAATACCTGGGCAATG-3' (SEQ ID NO: 2442)

5'-UGCUGAUGAAAUACCUGGGCAAUgc-3'     (SEQ ID NO: 2163)
            3'-CGACGACUACUUUAUGGACCCGUUACG-5'   (SEQ ID NO: 2303)
AAT-1076 Target: 5'-GCTGCTGATGAAATACCTGGGCAATGC-3' (SEQ ID NO: 2443)

5'-GCUGAUGAAAUACCUGGGCAAUGcc-3'     (SEQ ID NO: 2164)
            3'-GACGACUACUUUAUGGACCCGUUACGG-5'   (SEQ ID NO: 2304)
AAT-1077 Target: 5'-CTGCTGATGAAATACCTGGGCAATGCC-3' (SEQ ID NO: 2444)

5'-CUGAUGAAAUACCUGGGCAAUGCca-3'     (SEQ ID NO: 2165)
            3'-ACGACUACUUUAUGGACCCGUUACGGU-5'   (SEQ ID NO: 2305)
AAT-1078 Target: 5'-TGCTGATGAAATACCTGGGCAATGCCA-3' (SEQ ID NO: 2445)

5'-UGAUGAAAUACCUGGGCAAUGCCac-3'     (SEQ ID NO: 2166)
            3'-CGACUACUUUAUGGACCCGUUACGGUG-5'   (SEQ ID NO: 2306)
AAT-1079 Target: 5'-GCTGATGAAATACCTGGGCAATGCCAC-3' (SEQ ID NO: 2446)

5'-GAUGAAAUACCUGGGCAAUGCCAcc-3'     (SEQ ID NO: 2167)
            3'-GACUACUUUAUGGACCCGUUACGGUGG-5'   (SEQ ID NO: 2307)
AAT-1080 Target: 5'-CTGATGAAATACCTGGGCAATGCCACC-3' (SEQ ID NO: 2447)

5'-AUGAAAUACCUGGGCAAUGCCACcg-3'     (SEQ ID NO: 2168)
            3'-ACUACUUUAUGGACCCGUUACGGUGGC-5'   (SEQ ID NO: 2308)
AAT-1081 Target: 5'-TGATGAAATACCTGGGCAATGCCACCG-3' (SEQ ID NO: 2448)

5'-GAAAUACCUGGGCAAUGCCACCGcc-3'     (SEQ ID NO: 2169)
            3'-UACUUUAUGGACCCGUUACGGUGGCGG-5'   (SEQ ID NO: 2309)
AAT-1083 Target: 5'-ATGAAATACCTGGGCAATGCCACCGCC-3' (SEQ ID NO: 2449)

5'-CAGCACCUGGAAAAUGAACUCACcc-3'     (SEQ ID NO: 2170)
            3'-AUGUCGUGGACCUUUUACUUGAGUGGG-5'   (SEQ ID NO: 2310)
AAT-1138 Target: 5'-TACAGCACCTGGAAAATGAACTCACCC-3' (SEQ ID NO: 2450)

5'-CUGGAAAAUGAACUCACCCACGAta-3'     (SEQ ID NO: 2171)
            3'-UGGACCUUUUACUUGAGUGGGUGCUAU-5'   (SEQ ID NO: 2311)
AAT-1144 Target: 5'-ACCTGGAAAATGAACTCACCCACGATA-3' (SEQ ID NO: 2451)

5'-UGGAAAAUGAACUCACCCACGAUat-3'     (SEQ ID NO: 2172)
            3'-GGACCUUUUACUUGAGUGGGUGCUAUA-5'   (SEQ ID NO: 2312)
AAT-1145 Target: 5'-CCTGGAAAATGAACTCACCCACGATAT-3' (SEQ ID NO: 2452)
```

TABLE 12-continued

Further Human Anti-α-1 antitrypsin DsiRNA Agents (Asymmetrics)

```
                   5'-GAUAUCAUCACCAAGUUCCUGGAaa-3'      (SEQ ID NO: 2173)
                   3'-UGCUAUAGUAGUGGUUCAAGGACCUUU-5'    (SEQ ID NO: 2313)
AAT-1165 Target:   5'-ACGATATCATCACCAAGTTCCTGGAAA-3'    (SEQ ID NO: 2453)

5'-CAAGUUCCUGGAAAAUGAAGACAga-3'      (SEQ ID NO: 2174)
                   3'-UGGUUCAAGGACCUUUUACUUCUGUCU-5'    (SEQ ID NO: 2314)
AAT-1176 Target:   5'-ACCAAGTTCCTGGAAAATGAAGACAGA-3'    (SEQ ID NO: 2454)

5'-CCAUUACUGGAACCUAUGAUCUGAa-3'      (SEQ ID NO: 2175)
                   3'-CAGGUAAUGACCUUGGAUACUAGACUU-5'    (SEQ ID NO: 2315)
AAT-1232 Target:   5'-GTCCATTACTGGAACCTATGATCTGAA-3'    (SEQ ID NO: 2455)

5'-CAUUACUGGAACCUAUGAUCUGAag-3'      (SEQ ID NO: 2176)
                   3'-AGGUAAUGACCUUGGAUACUAGACUUC-5'    (SEQ ID NO: 2316)
AAT-1233 Target:   5'-TCCATTACTGGAACCTATGATCTGAAG-3'    (SEQ ID NO: 2456)

5'-AUUACUGGAACCUAUGAUCUGAAga-3'      (SEQ ID NO: 2177)
                   3'-GGUAAUGACCUUGGAUACUAGACUUCU-5'    (SEQ ID NO: 2317)
AAT-1234 Target:   5'-CCATTACTGGAACCTATGATCTGAAGA-3'    (SEQ ID NO: 2457)

5'-UUACUGGAACCUAUGAUCUGAAGag-3'      (SEQ ID NO: 2178)
                   3'-GUAAUGACCUUGGAUACUAGACUUCUC-5'    (SEQ ID NO: 2318)
AAT-1235 Target:   5'-CATTACTGGAACCTATGATCTGAAGAG-3'    (SEQ ID NO: 2458)

5'-UACUGGAACCUAUGAUCUGAAGAgc-3'      (SEQ ID NO: 2179)
                   3'-UAAUGACCUUGGAUACUAGACUUCUCG-5'    (SEQ ID NO: 2319)
AAT-1236 Target:   5'-ATTACTGGAACCTATGATCTGAAGAGC-3'    (SEQ ID NO: 2459)

5'-ACUGGAACCUAUGAUCUGAAGAGcg-3'      (SEQ ID NO: 2180)
                   3'-AAUGACCUUGGAUACUAGACUUCUCGC-5'    (SEQ ID NO: 2320)
AAT-1237 Target:   5'-TTACTGGAACCTATGATCTGAAGAGCG-3'    (SEQ ID NO: 2460)

5'-CUGGAACCUAUGAUCUGAAGAGCgt-3'      (SEQ ID NO: 2181)
                   3'-AUGACCUUGGAUACUAGACUUCUCGCA-5'    (SEQ ID NO: 2321)
AAT-1238 Target:   5'-TACTGGAACCTATGATCTGAAGAGCGT-3'    (SEQ ID NO: 2461)

5'-UGGAACCUAUGAUCUGAAGAGCGtc-3'      (SEQ ID NO: 2182)
                   3'-UGACCUUGGAUACUAGACUUCUCGCAG-5'    (SEQ ID NO: 2322)
AAT-1239 Target:   5'-ACTGGAACCTATGATCTGAAGAGCGTC-3'    (SEQ ID NO: 2462)

5'-GGAACCUAUGAUCUGAAGAGCGUcc-3'      (SEQ ID NO: 2183)
                   3'-GACCUUGGAUACUAGACUUCUCGCAGG-5'    (SEQ ID NO: 2323)
AAT-1240 Target:   5'-CTGGAACCTATGATCTGAAGAGCGTCC-3'    (SEQ ID NO: 2463)

5'-AUCACUAAGGUCUUCAGCAAUGGGg-3'      (SEQ ID NO: 2184)
                   3'-CGUAGUGAUUCCAGAAGUCGUUACCCC-5'    (SEQ ID NO: 2324)
AAT-1279 Target:   5'-GCATCACTAAGGTCTTCAGCAATGGGG-3'    (SEQ ID NO: 2464)

5'-UCACUAAGGUCUUCAGCAAUGGGgc-3'      (SEQ ID NO: 2185)
                   3'-GUAGUGAUUCCAGAAGUCGUUACCCCG-5'    (SEQ ID NO: 2325)
AAT-1280 Target:   5'-CATCACTAAGGTCTTCAGCAATGGGGC-3'    (SEQ ID NO: 2465)

5'-CACUAAGGUCUUCAGCAAUGGGGct-3'      (SEQ ID NO: 2186)
                   3'-UAGUGAUUCCAGAAGUCGUUACCCCGA-5'    (SEQ ID NO: 2326)
AAT-1281 Target:   5'-ATCACTAAGGTCTTCAGCAATGGGGCT-3'    (SEQ ID NO: 2466)

5'-CUAAGGUCUUCAGCAAUGGGGCUga-3'      (SEQ ID NO: 2187)
                   3'-GUGAUUCCAGAAGUCGUUACCCCGACU-5'    (SEQ ID NO: 2327)
AAT-1283 Target:   5'-CACTAAGGTCTTCAGCAATGGGGCTGA-3'    (SEQ ID NO: 2467)

5'-UAAGGUCUUCAGCAAUGGGGCUGac-3'      (SEQ ID NO: 2188)
                   3'-UGAUUCCAGAAGUCGUUACCCCGACUG-5'    (SEQ ID NO: 2328)
AAT-1284 Target:   5'-ACTAAGGTCTTCAGCAATGGGGCTGAC-3'    (SEQ ID NO: 2468)

5'-UGAAGCUCUCCAAGGCCGUGCAUaa-3'      (SEQ ID NO: 2189)
                   3'-GGACUUCGAGAGGUUCCGGCACGUAUU-5'    (SEQ ID NO: 2329)
AAT-1337 Target:   5'-CCTGAAGCTCTCCAAGGCCGTGCATAA-3'    (SEQ ID NO: 2469)

5'-GAAGCUCUCCAAGGCCGUGCAUAag-3'      (SEQ ID NO: 2190)
                   3'-GACUUCGAGAGGUUCCGGCACGUAUUC-5'    (SEQ ID NO: 2330)
AAT-1338 Target:   5'-CTGAAGCTCTCCAAGGCCGTGCATAAG-3'    (SEQ ID NO: 2470)

5'-AAGCUCUCCAAGGCCGUGCAUAAgg-3'      (SEQ ID NO: 2191)
                   3'-ACUUCGAGAGGUUCCGGCACGUAUUCC-5'    (SEQ ID NO: 2331)
AAT-1339 Target:   5'-TGAAGCTCTCCAAGGCCGTGCATAAGG-3'    (SEQ ID NO: 2471)
```

TABLE 12-continued

Further Human Anti-α-1 antitrypsin DsiRNA Agents (Asymmetrics)

```
                5'-CCGAGGUCAAGUUCAACAAACCCtt-3'      (SEQ ID NO: 2192)
                3'-GGGGCUCCAGUUCAAGUUGUUUGGGAA-5'    (SEQ ID NO: 2332)
AAT-1442 Target: 5'-CCCCGAGGTCAAGTTCAACAAACCCTT-3'   (SEQ ID NO: 2472)

5'-CGAGGUCAAGUUCAACAAACCCUtt-3'      (SEQ ID NO: 2193)
                3'-GGGCUCCAGUUCAAGUUGUUUGGGAAA-5'    (SEQ ID NO: 2333)
AAT-1443 Target: 5'-CCCGAGGTCAAGTTCAACAAACCCTTT-3'   (SEQ ID NO: 2473)

5'-GAGGUCAAGUUCAACAAACCCUUtg-3'      (SEQ ID NO: 2194)
                3'-GGCUCCAGUUCAAGUUGUUUGGGAAAC-5'    (SEQ ID NO: 2334)
AAT-1444 Target: 5'-CCGAGGTCAAGTTCAACAAACCCTTTG-3'   (SEQ ID NO: 2474)

5'-AGGUCAAGUUCAACAAACCCUUUgt-3'      (SEQ ID NO: 2195)
                3'-GCUCCAGUUCAAGUUGUUUGGGAAACA-5'    (SEQ ID NO: 2335)
AAT-1445 Target: 5'-CGAGGTCAAGTTCAACAAACCCTTTGT-3'   (SEQ ID NO: 2475)

5'-GGUCAAGUUCAACAAACCCUUUGtc-3'      (SEQ ID NO: 2196)
                3'-CUCCAGUUCAAGUUGUUUGGGAAACAG-5'    (SEQ ID NO: 2336)
AAT-1446 Target: 5'-GAGGTCAAGTTCAACAAACCCTTTGTC-3'   (SEQ ID NO: 2476)

5'-GUCAAGUUCAACAAACCCUUUGUct-3'      (SEQ ID NO: 2197)
                3'-UCCAGUUCAAGUUGUUUGGGAAACAGA-5'    (SEQ ID NO: 2337)
AAT-1447 Target: 5'-AGGTCAAGTTCAACAAACCCTTTGTCT-3'   (SEQ ID NO: 2477)

5'-UCAAGUUCAACAAACCCUUUGUCtt-3'      (SEQ ID NO: 2198)
                3'-CCAGUUCAAGUUGUUUGGGAAACAGAA-5'    (SEQ ID NO: 2338)
AAT-1448 Target: 5'-GGTCAAGTTCAACAAACCCTTTGTCTT-3'   (SEQ ID NO: 2478)

5'-CAAGUUCAACAAACCCUUUGUCUtc-3'      (SEQ ID NO: 2199)
                3'-CAGUUCAAGUUGUUUGGGAAACAGAAG-5'    (SEQ ID NO: 2339)
AAT-1449 Target: 5'-GTCAAGTTCAACAAACCCTTTGTCTTC-3'   (SEQ ID NO: 2479)

5'-AAGUUCAACAAACCCUUUGUCUUct-3'      (SEQ ID NO: 2200)
                3'-AGUUCAAGUUGUUUGGGAAACAGAAGA-5'    (SEQ ID NO: 2340)
AAT-1450 Target: 5'-TCAAGTTCAACAAACCCTTTGTCTTCT-3'   (SEQ ID NO: 2480)

5'-AGUUCAACAAACCCUUUGUCUUCtt-3'      (SEQ ID NO: 2201)
                3'-GUUCAAGUUGUUUGGGAAACAGAAGAA-5'    (SEQ ID NO: 2341)
AAT-1451 Target: 5'-CAAGTTCAACAAACCCTTTGTCTTCTT-3'   (SEQ ID NO: 2481)
```

TABLE 13

Further Human Anti-α-1 antitrypsin DsiRNAs, Unmodified Duplexes (Asymmetrics)

```
                5'-CCAGGGAGAUGCUGCCCAGAAGACA-3'      (SEQ ID NO: 2482)
                3'-GGGGUCCCUCUACGACGGGUCUUCUGU-5'    (SEQ ID NO: 2202)
AAT-366 Target: 5'-CCCCAGGGAGATGCTGCCCAGAAGACA-3'    (SEQ ID NO: 2342)

5'-CAGGGAGAUGCUGCCCAGAAGACAG-3'      (SEQ ID NO: 2483)
                3'-GGGUCCCUCUACGACGGGUCUUCUGUC-5'    (SEQ ID NO: 2203)
AAT-367 Target: 5'-CCCAGGGAGATGCTGCCCAGAAGACAG-3'    (SEQ ID NO: 2343)

5'-AGGGAGAUGCUGCCCAGAAGACAGA-3'      (SEQ ID NO: 2484)
                3'-GGUCCCUCUACGACGGGUCUUCUGUCU-5'    (SEQ ID NO: 2204)
AAT-368 Target: 5'-CCAGGGAGATGCTGCCCAGAAGACAGA-3'    (SEQ ID NO: 2344)

5'-GGGAGAUGCUGCCCAGAAGACAGAU-3'      (SEQ ID NO: 2485)
                3'-GUCCCUCUACGACGGGUCUUCUGUCUA-5'    (SEQ ID NO: 2205)
AAT-369 Target: 5'-CAGGGAGATGCTGCCCAGAAGACAGAT-3'    (SEQ ID NO: 2345)

5'-GGAGAUGCUGCCCAGAAGACAGAUA-3'      (SEQ ID NO: 2486)
                3'-UCCCUCUACGACGGGUCUUCUGUCUAU-5'    (SEQ ID NO: 2206)
AAT-370 Target: 5'-AGGGAGATGCTGCCCAGAAGACAGATA-3'    (SEQ ID NO: 2346)

5'-GAGAUGCUGCCCAGAAGACAGAUAC-3'      (SEQ ID NO: 2487)
                3'-CCCUCUACGACGGGUCUUCUGUCUAUG-5'    (SEQ ID NO: 2207)
AAT-371 Target: 5'-GGGAGATGCTGCCCAGAAGACAGATAC-3'    (SEQ ID NO: 2347)

5'-GAUACAUCCCACCAUGAUCAGGAUC-3'      (SEQ ID NO: 2488)
                3'-GUCUAUGUAGGGUGGUACUAGUCCUAG-5'    (SEQ ID NO: 2208)
AAT-391 Target: 5'-CAGATACATCCCACCATGATCAGGATC-3'    (SEQ ID NO: 2348)
```

TABLE 13-continued

Further Human Anti-α-1 antitrypsin DsiRNAs, Unmodified Duplexes
(Asymmetrics)

|  |  |  |
|---|---|---|
|  | 5'-AUACAUCCCACCAUGAUCAGGAUCA-3' | (SEQ ID NO: 2489) |
|  | 3'-UCUAUGUAGGGUGGUACUAGUCCUAGU-5' | (SEQ ID NO: 2209) |
| AAT-392 Target: | 5'-AGATACATCCCACCATGATCAGGATCA-3' | (SEQ ID NO: 2349) |
|  |  |  |
|  | 5'-UACAUCCCACCAUGAUCAGGAUCAC-3' | (SEQ ID NO: 2490) |
|  | 3'-CUAUGUAGGGUGGUACUAGUCCUAGUG-5' | (SEQ ID NO: 2210) |
| AAT-393 Target: | 5'-GATACATCCCACCATGATCAGGATCAC-3' | (SEQ ID NO: 2350) |
|  |  |  |
|  | 5'-ACAUCCCACCAUGAUCAGGAUCACC-3' | (SEQ ID NO: 2491) |
|  | 3'-UAUGUAGGGUGGUACUAGUCCUAGUGG-5' | (SEQ ID NO: 2211) |
| AAT-394 Target: | 5'-ATACATCCCACCATGATCAGGATCACC-3' | (SEQ ID NO: 2351) |
|  |  |  |
|  | 5'-ACCAGUCCAACAGCACCAAUAUCUU-3' | (SEQ ID NO: 2492) |
|  | 3'-UGGUCAGGUUGUCGUGGUUAUAGAA-5' | (SEQ ID NO: 2212) |
| AAT-485 Target: | 5'-ACACCAGTCCAACAGCACCAATATCTT-3' | (SEQ ID NO: 2352) |
|  |  |  |
|  | 5'-CCAGUCCAACAGCACCAAUAUCUUC-3' | (SEQ ID NO: 2493) |
|  | 3'-GUGGUCAGGUUGUCGUGGUUAUAGAAG-5' | (SEQ ID NO: 2213) |
| AAT-486 Target: | 5'-CACCAGTCCAACAGCACCAATATCTTC-3' | (SEQ ID NO: 2353) |
|  |  |  |
|  | 5'-CAGUCCAACAGCACCAAUAUCUUCU-3' | (SEQ ID NO: 2494) |
|  | 3'-UGGUCAGGUUGUCGUGGUUAUAGAAGA-5' | (SEQ ID NO: 2214) |
| AAT-487 Target: | 5'-ACCAGTCCAACAGCACCAATATCTTCT-3' | (SEQ ID NO: 2354) |
|  |  |  |
|  | 5'-AGUCCAACAGCACCAAUAUCUUCUU-3' | (SEQ ID NO: 2495) |
|  | 3'-GGUCAGGUUGUCGUGGUUAUAGAAGAA-5' | (SEQ ID NO: 2215) |
| AAT-488 Target: | 5'-CCAGTCCAACAGCACCAATATCTTCTT-3' | (SEQ ID NO: 2355) |
|  |  |  |
|  | 5'-GUCCAACAGCACCAAUAUCUUCUUC-3' | (SEQ ID NO: 2496) |
|  | 3'-GUCAGGUUGUCGUGGUUAUAGAAGAAG-5' | (SEQ ID NO: 2216) |
| AAT-489 Target: | 5'-CAGTCCAACAGCACCAATATCTTCTTC-3' | (SEQ ID NO: 2356) |
|  |  |  |
|  | 5'-UCCAACAGCACCAAUAUCUUCUUCU-3' | (SEQ ID NO: 2497) |
|  | 3'-UCAGGUUGUCGUGGUUAUAGAAGAAGA-5' | (SEQ ID NO: 2217) |
| AAT-490 Target: | 5'-AGTCCAACAGCACCAATATCTTCTTCT-3' | (SEQ ID NO: 2357) |
|  |  |  |
|  | 5'-CCAACAGCACCAAUAUCUUCUUCUC-3' | (SEQ ID NO: 2498) |
|  | 3'-CAGGUUGUCGUGGUUAUAGAAGAAGAG-5' | (SEQ ID NO: 2218) |
| AAT-491 Target: | 5'-GTCCAACAGCACCAATATCTTCTTCTC-3' | (SEQ ID NO: 2358) |
|  |  |  |
|  | 5'-CAACAGCACCAAUAUCUUCUUCUCC-3' | (SEQ ID NO: 2499) |
|  | 3'-AGGUUGUCGUGGUUAUAGAAGAAGAGG-5' | (SEQ ID NO: 2219) |
| AAT-492 Target: | 5'-TCCAACAGCACCAATATCTTCTTCTCC-3' | (SEQ ID NO: 2359) |
|  |  |  |
|  | 5'-AACAGCACCAAUAUCUUCUUCUCCC-3' | (SEQ ID NO: 2500) |
|  | 3'-GGUUGUCGUGGUUAUAGAAGAAGAGGG-5' | (SEQ ID NO: 2220) |
| AAT-493 Target: | 5'-CCAACAGCACCAATATCTTCTTCTCCC-3' | (SEQ ID NO: 2360) |
|  |  |  |
|  | 5'-ACAGCACCAAUAUCUUCUUCUCCCC-3' | (SEQ ID NO: 2501) |
|  | 3'-GUUGUCGUGGUUAUAGAAGAAGAGGGG-5' | (SEQ ID NO: 2221) |
| AAT-494 Target: | 5'-CAACAGCACCAATATCTTCTTCTCCCC-3' | (SEQ ID NO: 2361) |
|  |  |  |
|  | 5'-CAGCACCAAUAUCUUCUUCUCCCCA-3' | (SEQ ID NO: 2502) |
|  | 3'-UUGUCGUGGUUAUAGAAGAAGAGGGGU-5' | (SEQ ID NO: 2222) |
| AAT-495 Target: | 5'-AACAGCACCAATATCTTCTTCTCCCCA-3' | (SEQ ID NO: 2362) |
|  |  |  |
|  | 5'-AGCACCAAUAUCUUCUUCUCCCCAG-3' | (SEQ ID NO: 2503) |
|  | 3'-UGUCGUGGUUAUAGAAGAAGAGGGGUC-5' | (SEQ ID NO: 2223) |
| AAT-496 Target: | 5'-ACAGCACCAATATCTTCTTCTCCCCAG-3' | (SEQ ID NO: 2363) |
|  |  |  |
|  | 5'-GCACCAAUAUCUUCUUCUCCCCAGU-3' | (SEQ ID NO: 2504) |
|  | 3'-GUCGUGGUUAUAGAAGAAGAGGGGUCA-5' | (SEQ ID NO: 2224) |
| AAT-497 Target: | 5'-CAGCACCAATATCTTCTTCTCCCCAGT-3' | (SEQ ID NO: 2364) |
|  |  |  |
|  | 5'-CACCAAUAUCUUCUUCUCCCCAGUG-3' | (SEQ ID NO: 2505) |
|  | 3'-UCGUGGUUAUAGAAGAAGAGGGGUCAC-5' | (SEQ ID NO: 2225) |
| AAT-498 Target: | 5'-AGCACCAATATCTTCTTCTCCCCAGTG-3' | (SEQ ID NO: 2365) |
|  |  |  |
|  | 5'-ACCAAUAUCUUCUUCUCCCCAGUGA-3' | (SEQ ID NO: 2506) |
|  | 3'-CGUGGUUAUAGAAGAAGAGGGGUCACU-5' | (SEQ ID NO: 2226) |
| AAT-499 Target: | 5'-GCACCAATATCTTCTTCTCCCCAGTGA-3' | (SEQ ID NO: 2366) |
|  |  |  |
|  | 5'-CCCAGUGAGCAUCGCUACAGCCUUU-3' | (SEQ ID NO: 2507) |
|  | 3'-AGGGGUCACUCGUAGCGAUGUCGGAAA-5' | (SEQ ID NO: 2227) |
| AAT-516 Target: | 5'-TCCCCAGTGAGCATCGCTACAGCCTTT-3' | (SEQ ID NO: 2367) |

TABLE 13-continued

Further Human Anti-α-1 antitrypsin DsiRNAs, Unmodified Duplexes
(Asymmetrics)

| | | |
|---|---|---|
| AAT-517 Target: | 5'-CCAGUGAGCAUCGCUACAGCCUUUG-3'<br>3'-GGGGUCACUCGUAGCGAUGUCGGAAAC-5'<br>5'-CCCCAGTGAGCATCGCTACAGCCTTTG-3' | (SEQ ID NO: 2508)<br>(SEQ ID NO: 2228)<br>(SEQ ID NO: 2368) |
| AAT-518 Target: | 5'-CAGUGAGCAUCGCUACAGCCUUUGC-3'<br>3'-GGGUCACUCGUAGCGAUGUCGGAAACG-5'<br>5'-CCCAGTGAGCATCGCTACAGCCTTTGC-3' | (SEQ ID NO: 2509)<br>(SEQ ID NO: 2229)<br>(SEQ ID NO: 2369) |
| AAT-519 Target: | 5'-AGUGAGCAUCGCUACAGCCUUUGCA-3'<br>3'-GGUCACUCGUAGCGAUGUCGGAAACGU-5'<br>5'-CCAGTGAGCATCGCTACAGCCTTTGCA-3' | (SEQ ID NO: 2510)<br>(SEQ ID NO: 2230)<br>(SEQ ID NO: 2370) |
| AAT-520 Target: | 5'-GUGAGCAUCGCUACAGCCUUUGCAA-3'<br>3'-GUCACUCGUAGCGAUGUCGGAAACGUU-5'<br>5'-CAGTGAGCATCGCTACAGCCTTTGCAA-3' | (SEQ ID NO: 2511)<br>(SEQ ID NO: 2231)<br>(SEQ ID NO: 2371) |
| AAT-521 Target: | 5'-UGAGCAUCGCUACAGCCUUUGCAAU-3'<br>3'-UCACUCGUAGCGAUGUCGGAAACGUUA-5'<br>5'-AGTGAGCATCGCTACAGCCTTTGCAAT-3' | (SEQ ID NO: 2512)<br>(SEQ ID NO: 2232)<br>(SEQ ID NO: 2372) |
| AAT-522 Target: | 5'-GAGCAUCGCUACAGCCUUUGCAAUG-3'<br>3'-CACUCGUAGCGAUGUCGGAAACGUUAC-5'<br>5'-GTGAGCATCGCTACAGCCTTTGCAATG-3' | (SEQ ID NO: 2513)<br>(SEQ ID NO: 2233)<br>(SEQ ID NO: 2373) |
| AAT-523 Target: | 5'-AGCAUCGCUACAGCCUUUGCAAUGC-3'<br>3'-ACUCGUAGCGAUGUCGGAAACGUUACG-5'<br>5'-TGAGCATCGCTACAGCCTTTGCAATGC-3' | (SEQ ID NO: 2514)<br>(SEQ ID NO: 2234)<br>(SEQ ID NO: 2374) |
| AAT-524 Target: | 5'-GCAUCGCUACAGCCUUUGCAAUGCU-3'<br>3'-CUCGUAGCGAUGUCGGAAACGUUACGA-5'<br>5'-GAGCATCGCTACAGCCTTTGCAATGCT-3' | (SEQ ID NO: 2515)<br>(SEQ ID NO: 2235)<br>(SEQ ID NO: 2375) |
| AAT-525 Target: | 5'-CAUCGCUACAGCCUUUGCAAUGCUC-3'<br>3'-UCGUAGCGAUGUCGGAAACGUUACGAG-5'<br>5'-AGCATCGCTACAGCCTTTGCAATGCTC-3' | (SEQ ID NO: 2516)<br>(SEQ ID NO: 2236)<br>(SEQ ID NO: 2376) |
| AAT-526 Target: | 5'-AUCGCUACAGCCUUUGCAAUGCUCU-3'<br>3'-CGUAGCGAUGUCGGAAACGUUACGAGA-5'<br>5'-GCATCGCTACAGCCTTTGCAATGCTCT-3' | (SEQ ID NO: 2517)<br>(SEQ ID NO: 2237)<br>(SEQ ID NO: 2377) |
| AAT-527 Target: | 5'-UCGCUACAGCCUUUGCAAUGCUCUC-3'<br>3'-GUAGCGAUGUCGGAAACGUUACGAGAG-5'<br>5'-CATCGCTACAGCCTTTGCAATGCTCTC-3' | (SEQ ID NO: 2518)<br>(SEQ ID NO: 2238)<br>(SEQ ID NO: 2378) |
| AAT-528 Target: | 5'-CGCUACAGCCUUUGCAAUGCUCUCC-3'<br>3'-UAGCGAUGUCGGAAACGUUACGAGAGG-5'<br>5'-ATCGCTACAGCCTTTGCAATGCTCTCC-3' | (SEQ ID NO: 2519)<br>(SEQ ID NO: 2239)<br>(SEQ ID NO: 2379) |
| AAT-529 Target: | 5'-GCUACAGCCUUUGCAAUGCUCUCCC-3'<br>3'-AGCGAUGUCGGAAACGUUACGAGAGGG-5'<br>5'-TCGCTACAGCCTTTGCAATGCTCTCCC-3' | (SEQ ID NO: 2520)<br>(SEQ ID NO: 2240)<br>(SEQ ID NO: 2380) |
| AAT-530 Target: | 5'-CUACAGCCUUUGCAAUGCUCUCCCU-3'<br>3'-GCGAUGUCGGAAACGUUACGAGAGGGA-5'<br>5'-CGCTACAGCCTTTGCAATGCTCTCCCT-3' | (SEQ ID NO: 2521)<br>(SEQ ID NO: 2241)<br>(SEQ ID NO: 2381) |
| AAT-531 Target: | 5'-UACAGCCUUUGCAAUGCUCUCCCUG-3'<br>3'-CGAUGUCGGAAACGUUACGAGAGGGAC-5'<br>5'-GCTACAGCCTTTGCAATGCTCTCCCTG-3' | (SEQ ID NO: 2522)<br>(SEQ ID NO: 2242)<br>(SEQ ID NO: 2382) |
| AAT-552 Target: | 5'-CCUGGGGACCAAGGCUGACACUCAC-3'<br>3'-AGGGACCCCUGGUUCCGACUGUGAGUG-5'<br>5'-TCCCTGGGGACCAAGGCTGACACTCAC-3' | (SEQ ID NO: 2523)<br>(SEQ ID NO: 2243)<br>(SEQ ID NO: 2383) |
| AAT-556 Target: | 5'-GGGACCAAGGCUGACACUCACGAUG-3'<br>3'-ACCCCUGGUUCCGACUGUGAGUGCUAC-5'<br>5'-TGGGACCAAGGCTGACACTCACGATG-3' | (SEQ ID NO: 2524)<br>(SEQ ID NO: 2244)<br>(SEQ ID NO: 2384) |
| AAT-557 Target: | 5'-GGACCAAGGCUGACACUCACGAUGA-3'<br>3'-CCCCUGGUUCCGACUGUGAGUGCUACU-5'<br>5'-GGGGACCAAGGCTGACACTCACGATGA-3' | (SEQ ID NO: 2525)<br>(SEQ ID NO: 2245)<br>(SEQ ID NO: 2385) |
| AAT-558 Target: | 5'-GACCAAGGCUGACACUCACGAUGAA-3'<br>3'-CCCUGGUUCCGACUGUGAGUGCUACUU-5'<br>5'-GGGACCAAGGCTGACACTCACGATGAA-3' | (SEQ ID NO: 2526)<br>(SEQ ID NO: 2246)<br>(SEQ ID NO: 2386) |

TABLE 13-continued

Further Human Anti-α-1 antitrypsin DsiRNAs, Unmodified Duplexes
(Asymmetrics)

|  |  |  |
|---|---|---|
|  | 5'-UGAAAUCCUGGAGGGCCUGAAUUUC-3' | (SEQ ID NO: 2527) |
|  | 3'-CUACUUUAGGACCUCCCGGACUUAAAG-5' | (SEQ ID NO: 2247) |
| AAT-579 Target: | 5'-GATGAAATCCTGGAGGGCCTGAATTTC-3' | (SEQ ID NO: 2387) |
|  | 5'-GAAAUCCUGGAGGGCCUGAAUUUCA-3' | (SEQ ID NO: 2528) |
|  | 3'-UACUUUAGGACCUCCCGGACUUAAAGU-5' | (SEQ ID NO: 2248) |
| AAT-580 Target: | 5'-ATGAAATCCTGGAGGGCCTGAATTTCA-3' | (SEQ ID NO: 2388) |
|  | 5'-UCCAUGAAGGCUUCCAGGAACUCCU-3' | (SEQ ID NO: 2529) |
|  | 3'-CUAGGUACUUCCGAAGGUCCUUGAGGA-5' | (SEQ ID NO: 2249) |
| AAT-632 Target: | 5'-GATCCATGAAGGCTTCCAGGAACTCCT-3' | (SEQ ID NO: 2389) |
|  | 5'-CCAUGAAGGCUUCCAGGAACUCCUC-3' | (SEQ ID NO: 2530) |
|  | 3'-UAGGUACUUCCGAAGGUCCUUGAGGAG-5' | (SEQ ID NO: 2250) |
| AAT-633 Target: | 5'-ATCCATGAAGGCTTCCAGGAACTCCTC-3' | (SEQ ID NO: 2390) |
|  | 5'-GGACACCGAAGAGGCCAAGAAACAG-3' | (SEQ ID NO: 2531) |
|  | 3'-CCCCUGUGGCUUCUCCGGUUCUUUGUC-5' | (SEQ ID NO: 2251) |
| AAT-801 Target: | 5'-GGGGACACCGAAGAGGCCAAGAAACAG-3' | (SEQ ID NO: 2391) |
|  | 5'-GACACCGAAGAGGCCAAGAAACAGA-3' | (SEQ ID NO: 2532) |
|  | 3'-CCCUGUGGCUUCUCCGGUUCUUUGUCU-5' | (SEQ ID NO: 2252) |
| AAT-802 Target: | 5'-GGGACACCGAAGAGGCCAAGAAACAGA-3' | (SEQ ID NO: 2392) |
|  | 5'-ACACCGAAGAGGCCAAGAAACAGAU-3' | (SEQ ID NO: 2533) |
|  | 3'-CCUGUGGCUUCUCCGGUUCUUUGUCUA-5' | (SEQ ID NO: 2253) |
| AAT-803 Target: | 5'-GGACACCGAAGAGGCCAAGAAACAGAT-3' | (SEQ ID NO: 2393) |
|  | 5'-CACCGAAGAGGCCAAGAAACAGAUC-3' | (SEQ ID NO: 2534) |
|  | 3'-CUGUGGCUUCUCCGGUUCUUUGUCUAG-5' | (SEQ ID NO: 2254) |
| AAT-804 Target: | 5'-GACACCGAAGAGGCCAAGAAACAGATC-3' | (SEQ ID NO: 2394) |
|  | 5'-ACCGAAGAGGCCAAGAAACAGAUCA-3' | (SEQ ID NO: 2535) |
|  | 3'-UGUGGCUUCUCCGGUUCUUUGUCUAGU-5' | (SEQ ID NO: 2255) |
| AAT-805 Target: | 5'-ACACCGAAGAGGCCAAGAAACAGATCA-3' | (SEQ ID NO: 2395) |
|  | 5'-CCGAAGAGGCCAAGAAACAGAUCAA-3' | (SEQ ID NO: 2536) |
|  | 3'-GUGGCUUCUCCGGUUCUUUGUCUAGUU-5' | (SEQ ID NO: 2256) |
| AAT-806 Target: | 5'-CACCGAAGAGGCCAAGAAACAGATCAA-3' | (SEQ ID NO: 2396) |
|  | 5'-CGAAGAGGCCAAGAAACAGAUCAAC-3' | (SEQ ID NO: 2537) |
|  | 3'-UGGCUUCUCCGGUUCUUUGUCUAGUUG-5' | (SEQ ID NO: 2257) |
| AAT-807 Target: | 5'-ACCGAAGAGGCCAAGAAACAGATCAAC-3' | (SEQ ID NO: 2397) |
|  | 5'-GAAGAGGCCAAGAAACAGAUCAACG-3' | (SEQ ID NO: 2538) |
|  | 3'-GGCUUCUCCGGUUCUUUGUCUAGUUGC-5' | (SEQ ID NO: 2258) |
| AAT-808 Target: | 5'-CCGAAGAGGCCAAGAAACAGATCAACG-3' | (SEQ ID NO: 2398) |
|  | 5'-AAGAGGCCAAGAAACAGAUCAACGA-3' | (SEQ ID NO: 2539) |
|  | 3'-GCUUCUCCGGUUCUUUGUCUAGUUGCU-5' | (SEQ ID NO: 2259) |
| AAT-809 Target: | 5'-CGAAGAGGCCAAGAAACAGATCAACGA-3' | (SEQ ID NO: 2399) |
|  | 5'-AGAGGCCAAGAAACAGAUCAACGAU-3' | (SEQ ID NO: 2540) |
|  | 3'-CUUCUCCGGUUCUUUGUCUAGUUGCUA-5' | (SEQ ID NO: 2260) |
| AAT-810 Target: | 5'-GAAGAGGCCAAGAAACAGATCAACGAT-3' | (SEQ ID NO: 2400) |
|  | 5'-GAGGCCAAGAAACAGAUCAACGAUU-3' | (SEQ ID NO: 2541) |
|  | 3'-UUCUCCGGUUCUUUGUCUAGUUGCUAA-5' | (SEQ ID NO: 2261) |
| AAT-811 Target: | 5'-AAGAGGCCAAGAAACAGATCAACGATT-3' | (SEQ ID NO: 2401) |
|  | 5'-AGGCCAAGAAACAGAUCAACGAUUA-3' | (SEQ ID NO: 2542) |
|  | 3'-UCUCCGGUUCUUUGUCUAGUUGCUAAU-5' | (SEQ ID NO: 2262) |
| AAT-812 Target: | 5'-AGAGGCCAAGAAACAGATCAACGATTA-3' | (SEQ ID NO: 2402) |
|  | 5'-GGCCAAGAAACAGAUCAACGAUUAC-3' | (SEQ ID NO: 2543) |
|  | 3'-CUCCGGUUCUUUGUCUAGUUGCUAAUG-5' | (SEQ ID NO: 2263) |
| AAT-813 Target: | 5'-GAGGCCAAGAAACAGATCAACGATTAC-3' | (SEQ ID NO: 2403) |
|  | 5'-UUUUGCUCUGGUGAAUUACAUCUUC-3' | (SEQ ID NO: 2544) |
|  | 3'-CAAAAACGAGACCACUUAAUGUAGAAG-5' | (SEQ ID NO: 2264) |
| AAT-900 Target: | 5'-GTTTTGCTCTGGTGAATTACATCTTC-3' | (SEQ ID NO: 2404) |
|  | 5'-UUUGCUCUGGUGAAUUACAUCUUCU-3' | (SEQ ID NO: 2545) |
|  | 3'-AAAAACGAGACCACUUAAUGUAGAAGA-5' | (SEQ ID NO: 2265) |
| AAT-901 Target: | 5'-TTTTGCTCTGGTGAATTACATCTTCT-3' | (SEQ ID NO: 2405) |

TABLE 13-continued

Further Human Anti-α-1 antitrypsin DsiRNAs, Unmodified Duplexes
(Asymmetrics)

```
                5'-UUGCUCGGUGAAUUACAUCUUCUU-3'       (SEQ ID NO: 2546)
                3'-AAAACGAGACCACUUAAUGUAGAAGAA-5'    (SEQ ID NO: 2266)
AAT-902 Target: 5'-TTTTGCTCTGGTGAATTACATCTTCTT-3'    (SEQ ID NO: 2406)

5'-UGCUCGGUGAAUUACAUCUUCUUU-3'       (SEQ ID NO: 2547)
                3'-AAACGAGACCACUUAAUGUAGAAGAAA-5'    (SEQ ID NO: 2267)
AAT-903 Target: 5'-TTTGCTCTGGTGAATTACATCTTCTTT-3'    (SEQ ID NO: 2407)

5'-GCUCGGUGAAUUACAUCUUCUUUA-3'       (SEQ ID NO: 2548)
                3'-AACGAGACCACUUAAUGUAGAAGAAAU-5'    (SEQ ID NO: 2268)
AAT-904 Target: 5'-TTGCTCTGGTGAATTACATCTTCTTTA-3'    (SEQ ID NO: 2408)

5'-CUCGGUGAAUUACAUCUUCUUUAA-3'       (SEQ ID NO: 2549)
                3'-ACGAGACCACUUAAUGUAGAAGAAAUU-5'    (SEQ ID NO: 2269)
AAT-905 Target: 5'-TGCTCTGGTGAATTACATCTTCTTTAA-3'    (SEQ ID NO: 2409)

5'-UCGGUGAAUUACAUCUUCUUUAAA-3'       (SEQ ID NO: 2550)
                3'-CGAGACCACUUAAUGUAGAAGAAAUUU-5'    (SEQ ID NO: 2270)
AAT-906 Target: 5'-GCTCTGGTGAATTACATCTTCTTTAAA-3'    (SEQ ID NO: 2410)

5'-CGGUGAAUUACAUCUUCUUUAAAG-3'       (SEQ ID NO: 2551)
                3'-GAGACCACUUAAUGUAGAAGAAAUUUC-5'    (SEQ ID NO: 2271)
AAT-907 Target: 5'-CTCTGGTGAATTACATCTTCTTTAAAG-3'    (SEQ ID NO: 2411)

5'-GGUGAAUUACAUCUUCUUUAAAGG-3'       (SEQ ID NO: 2552)
                3'-AGACCACUUAAUGUAGAAGAAAUUUCC-5'    (SEQ ID NO: 2272)
AAT-908 Target: 5'-TCTGGTGAATTACATCTTCTTTAAAGG-3'    (SEQ ID NO: 2412)

5'-GGUGAAUUACAUCUUCUUUAAAGGC-3'      (SEQ ID NO: 2553)
                3'-GACCACUUAAUGUAGAAGAAAUUUCCG-5'    (SEQ ID NO: 2273)
AAT-909 Target: 5'-CTGGTGAATTACATCTTCTTTAAAGGC-3'    (SEQ ID NO: 2413)

5'-GUGAAUUACAUCUUCUUUAAAGGCA-3'      (SEQ ID NO: 2554)
                3'-ACCACUUAAUGUAGAAGAAAUUUCCGU-5'    (SEQ ID NO: 2274)
AAT-910 Target: 5'-TGGTGAATTACATCTTCTTTAAAGGCA-3'    (SEQ ID NO: 2414)

5'-UGAAUUACAUCUUCUUUAAAGGCAA-3'      (SEQ ID NO: 2555)
                3'-CCACUUAAUGUAGAAGAAAUUUCCGUU-5'    (SEQ ID NO: 2275)
AAT-911 Target: 5'-GGTGAATTACATCTTCTTTAAAGGCAA-3'    (SEQ ID NO: 2415)

5'-GAAUUACAUCUUCUUUAAAGGCAAA-3'      (SEQ ID NO: 2556)
                3'-CACUUAAUGUAGAAGAAAUUUCCGUUU-5'    (SEQ ID NO: 2276)
AAT-912 Target: 5'-GTGAATTACATCTTCTTTAAAGGCAAA-3'    (SEQ ID NO: 2416)

5'-AAUUACAUCUUCUUUAAAGGCAAAU-3'      (SEQ ID NO: 2557)
                3'-ACUUAAUGUAGAAGAAAUUUCCGUUUA-5'    (SEQ ID NO: 2277)
AAT-913 Target: 5'-TGAATTACATCTTCTTTAAAGGCAAAT-3'    (SEQ ID NO: 2417)

5'-AUUACAUCUUCUUUAAAGGCAAAUG-3'      (SEQ ID NO: 2558)
                3'-CUUAAUGUAGAAGAAAUUUCCGUUUAC-5'    (SEQ ID NO: 2278)
AAT-914 Target: 5'-GAATTACATCTTCTTTAAAGGCAAATG-3'    (SEQ ID NO: 2418)

5'-UUACAUCUUCUUUAAAGGCAAAUGG-3'      (SEQ ID NO: 2559)
                3'-UUAAUGUAGAAGAAAUUUCCGUUUACC-5'    (SEQ ID NO: 2279)
AAT-915 Target: 5'-AATTACATCTTCTTTAAAGGCAAATGG-3'    (SEQ ID NO: 2419)

5'-UACAUCUUCUUUAAAGGCAAAUGGG-3'      (SEQ ID NO: 2560)
                3'-UAAUGUAGAAGAAAUUUCCGUUUACCC-5'    (SEQ ID NO: 2280)
AAT-916 Target: 5'-ATTACATCTTCTTTAAAGGCAAATGGG-3'    (SEQ ID NO: 2420)

5'-ACAUCUUCUUUAAAGGCAAAUGGGA-3'      (SEQ ID NO: 2561)
                3'-AAUGUAGAAGAAAUUUCCGUUUACCCU-5'    (SEQ ID NO: 2281)
AAT-917 Target: 5'-TTACATCTTCTTTAAAGGCAAATGGGA-3'    (SEQ ID NO: 2421)

5'-CAUCUUCUUUAAAGGCAAAUGGGAG-3'      (SEQ ID NO: 2562)
                3'-AUGUAGAAGAAAUUUCCGUUUACCCUC-5'    (SEQ ID NO: 2282)
AAT-918 Target: 5'-TACATCTTCTTTAAAGGCAAATGGGAG-3'    (SEQ ID NO: 2422)

5'-UUCUUUAAAGGCAAAUGGGAGAGAC-3'      (SEQ ID NO: 2563)
                3'-AGAAGAAAUUUCCGUUUACCCUCUCUG-5'    (SEQ ID NO: 2283)
AAT-922 Target: 5'-TCTTCTTTAAAGGCAAATGGGAGAGAC-3'    (SEQ ID NO: 2423)

5'-CUUUAAAGGCAAAUGGGAGAGACCC-3'      (SEQ ID NO: 2564)
                3'-AAGAAAUUUCCGUUUACCCUCUCUGGG-5'    (SEQ ID NO: 2284)
AAT-924 Target: 5'-TTCTTTAAAGGCAAATGGGAGAGACCC-3'    (SEQ ID NO: 2424)
```

TABLE 13-continued

Further Human Anti-α-1 antitrypsin DsiRNAs, Unmodified Duplexes (Asymmetrics)

```
               5'-GCAAAUGGGAGAGACCCUUUGAAGU-3'    (SEQ ID NO: 2565)
               3'-UCCGUUUACCCUCUCUGGGAAACUUCA-5'  (SEQ ID NO: 2285)
AAT-932 Target: 5'-AGGCAAATGGGAGAGACCCTTTGAAGT-3' (SEQ ID NO: 2425)

5'-CAAAUGGGAGAGACCCUUUGAAGUC-3'    (SEQ ID NO: 2566)
               3'-CCGUUUACCCUCUCUGGGAAACUUCAG-5'  (SEQ ID NO: 2286)
AAT-933 Target: 5'-GGCAAATGGGAGAGACCCTTTGAAGTC-3' (SEQ ID NO: 2426)

5'-AAAUGGGAGAGACCCUUUGAAGUCA-3'    (SEQ ID NO: 2567)
               3'-CGUUUACCCUCUCUGGGAAACUUCAGU-5'  (SEQ ID NO: 2287)
AAT-934 Target: 5'-GCAAATGGGAGAGACCCTTTGAAGTCA-3' (SEQ ID NO: 2427)

5'-AAUGGGAGAGACCCUUUGAAGUCAA-3'    (SEQ ID NO: 2568)
               3'-GUUUACCCUCUCUGGGAAACUUCAGUU-5'  (SEQ ID NO: 2288)
AAT-935 Target: 5'-CAAATGGGAGAGACCCTTTGAAGTCAA-3' (SEQ ID NO: 2428)

5'-UGUCCAGCUGGGUGCUGCUGAUGAA-3'    (SEQ ID NO: 2569)
                3'-CGACAGGUCGACCCACGACGACUACUU-5'  (SEQ ID NO: 2289)
AAT-1061 Target: 5'-GCTGTCCAGCTGGGTGCTGCTGATGAA-3' (SEQ ID NO: 2429)

5'-GUCCAGCUGGGUGCUGCUGAUGAAA-3'    (SEQ ID NO: 2570)
                3'-GACAGGUCGACCCACGACGACUACUUU-5'  (SEQ ID NO: 2290)
AAT-1062 Target: 5'-CTGTCCAGCTGGGTGCTGCTGATGAAA-3' (SEQ ID NO: 2430)

5'-UCCAGCUGGGUGCUGCUGAUGAAAU-3'    (SEQ ID NO: 2571)
                3'-ACAGGUCGACCCACGACGACUACUUUA-5'  (SEQ ID NO: 2291)
AAT-1063 Target: 5'-TGTCCAGCTGGGTGCTGCTGATGAAAT-3' (SEQ ID NO: 2431)

5'-CCAGCUGGGUGCUGCUGAUGAAAUA-3'    (SEQ ID NO: 2572)
                3'-CAGGUCGACCCACGACGACUACUUUAU-5'  (SEQ ID NO: 2292)
AAT-1064 Target: 5'-GTCCAGCTGGGTGCTGCTGATGAAATA-3' (SEQ ID NO: 2432)

5'-CAGCUGGGUGCUGCUGAUGAAAUAC-3'    (SEQ ID NO: 2573)
                3'-AGGUCGACCCACGACGACUACUUUAUG-5'  (SEQ ID NO: 2293)
AAT-1065 Target: 5'-TCCAGCTGGGTGCTGCTGATGAAATAC-3' (SEQ ID NO: 2433)

5'-AGCUGGGUGCUGCUGAUGAAAUACC-3'    (SEQ ID NO: 2574)
                3'-GGUCGACCCACGACGACUACUUUAUGG-5'  (SEQ ID NO: 2294)
AAT-1066 Target: 5'-CCAGCTGGGTGCTGCTGATGAAATACC-3' (SEQ ID NO: 2434)

5'-GCUGGGUGCUGCUGAUGAAAUACCU-3'    (SEQ ID NO: 2575)
                3'-GUCGACCCACGACGACUACUUUAUGGA-5'  (SEQ ID NO: 2295)
AAT-1067 Target: 5'-CAGCTGGGTGCTGCTGATGAAATACCT-3' (SEQ ID NO: 2435)

5'-CUGGGUGCUGCUGAUGAAAUACCUG-3'    (SEQ ID NO: 2576)
                3'-UCGACCCACGACGACUACUUUAUGGAC-5'  (SEQ ID NO: 2296)
AAT-1068 Target: 5'-AGCTGGGTGCTGCTGATGAAATACCTG-3' (SEQ ID NO: 2436)

5'-UGGGUGCUGCUGAUGAAAUACCUGG-3'    (SEQ ID NO: 2577)
                3'-CGACCCACGACGACUACUUUAUGGACC-5'  (SEQ ID NO: 2297)
AAT-1069 Target: 5'-GCTGGGTGCTGCTGATGAAATACCTGG-3' (SEQ ID NO: 2437)

5'-GGGUGCUGCUGAUGAAAUACCUGGG-3'    (SEQ ID NO: 2578)
                3'-GACCCACGACGACUACUUUAUGGACCC-5'  (SEQ ID NO: 2298)
AAT-1070 Target: 5'-CTGGGTGCTGCTGATGAAATACCTGGG-3' (SEQ ID NO: 2438)

5'-GUGCUGCUGAUGAAAUACCUGGGCA-3'    (SEQ ID NO: 2579)
                3'-CCCACGACGACUACUUUAUGGACCCGU-5'  (SEQ ID NO: 2299)
AAT-1072 Target: 5'-GGGTGCTGCTGATGAAATACCTGGGCA-3' (SEQ ID NO: 2439)

5'-UGCUGCUGAUGAAAUACCUGGGCAA-3'    (SEQ ID NO: 2580)
                3'-CCACGACGACUACUUUAUGGACCCGUU-5'  (SEQ ID NO: 2300)
AAT-1073 Target: 5'-GGTGCTGCTGATGAAATACCTGGGCAA-3' (SEQ ID NO: 2440)

5'-GCUGCUGAUGAAAUACCUGGGCAAU-3'    (SEQ ID NO: 2581)
                3'-CACGACGACUACUUUAUGGACCCGUUA-5'  (SEQ ID NO: 2301)
AAT-1074 Target: 5'-GTGCTGCTGATGAAATACCTGGGCAAT-3' (SEQ ID NO: 2441)

5'-CUGCUGAUGAAAUACCUGGGCAAUG-3'    (SEQ ID NO: 2582)
                3'-ACGACGACUACUUUAUGGACCCGUUAC-5'  (SEQ ID NO: 2302)
AAT-1075 Target: 5'-TGCTGCTGATGAAATACCTGGGCAATG-3' (SEQ ID NO: 2442)

5'-UGCUGAUGAAAUACCUGGGCAAUGC-3'    (SEQ ID NO: 2583)
                3'-CGACGACUACUUUAUGGACCCGUUACG-5' (SEQ ID NO: 2303)
AAT-1076 Target: 5'-GCTGCTGATGAAATACCTGGGCAATGC-3' (SEQ ID NO: 2443)
```

TABLE 13-continued

Further Human Anti-α-1 antitrypsin DsiRNAs, Unmodified Duplexes
(Asymmetrics)

```
              5'-GCUGAUGAAAUACCUGGGCAAUGCC-3'      (SEQ ID NO: 2584)
              3'-GACGACUACUUUAUGGACCCGUUACGG-5'   (SEQ ID NO: 2304)
AAT-1077 Target: 5'-CTGCTGATGAAATACCTGGGCAATGCC-3' (SEQ ID NO: 2444)

5'-CUGAUGAAAUACCUGGGCAAUGCCA-3'     (SEQ ID NO: 2585)
              3'-ACGACUACUUUAUGGACCCGUUACGGU-5'  (SEQ ID NO: 2305)
AAT-1078 Target: 5'-TGCTGATGAAATACCTGGGCAATGCCA-3' (SEQ ID NO: 2445)

5'-UGAUGAAAUACCUGGGCAAUGCCAC-3'     (SEQ ID NO: 2586)
              3'-CGACUACUUUAUGGACCCGUUACGGUG-5'  (SEQ ID NO: 2306)
AAT-1079 Target: 5'-GCTGATGAAATACCTGGGCAATGCCAC-3' (SEQ ID NO: 2446)

5'-GAUGAAAUACCUGGGCAAUGCCACC-3'     (SEQ ID NO: 2587)
              3'-GACUACUUUAUGGACCCGUUACGGUGG-5'  (SEQ ID NO: 2307)
AAT-1080 Target: 5'-CTGATGAAATACCTGGGCAATGCCACC-3' (SEQ ID NO: 2447)

5'-AUGAAAUACCUGGGCAAUGCCACCG-3'     (SEQ ID NO: 2588)
              3'-ACUACUUUAUGGACCCGUUACGGUGGC-5'  (SEQ ID NO: 2308)
AAT-1081 Target: 5'-TGATGAAATACCTGGGCAATGCCACCG-3' (SEQ ID NO: 2448)

5'-GAAAUACCUGGGCAAUGCCACCGCC-3'     (SEQ ID NO: 2589)
              3'-UACUUUAUGGACCCGUUACGGUGGCGG-5'  (SEQ ID NO: 2309)
AAT-1083 Target: 5'-ATGAAATACCTGGGCAATGCCACCGCC-3' (SEQ ID NO: 2449)

5'-CAGCACCUGGAAAAUGAACUCACCC-3'     (SEQ ID NO: 2590)
              3'-AUGUCGUGGACCUUUUACUUGAGUGGG-5'  (SEQ ID NO: 2310)
AAT-1138 Target: 5'-TACAGCACCTGGAAAATGAACTCACCC-3' (SEQ ID NO: 2450)

5'-CUGGAAAAUGAACUCACCCACGAUA-3'     (SEQ ID NO: 2591)
              3'-UGGACCUUUUACUUGAGUGGGUGCUAU-5'  (SEQ ID NO: 2311)
AAT-1144 Target: 5'-ACCTGGAAAATGAACTCACCCACGATA-3' (SEQ ID NO: 2451)

5'-UGGAAAAUGAACUCACCCACGAUAU-3'     (SEQ ID NO: 2592)
              3'-GGACCUUUUACUUGAGUGGGUGCUAUA-5'  (SEQ ID NO: 2312)
AAT-1145 Target: 5'-CCTGGAAAATGAACTCACCCACGATAT-3' (SEQ ID NO: 2452)

5'-GAUAUCAUCACCAAGUUCCUGGAAA-3'     (SEQ ID NO: 2593)
              3'-UGCUAUAGUAGUGGUUCAAGGACCUUU-5'  (SEQ ID NO: 2313)
AAT-1165 Target: 5'-ACGATATCATCACCAAGTTCCTGGAAA-3' (SEQ ID NO: 2453)

5'-CAAGUUCCUGGAAAAUGAAGACAGA-3'     (SEQ ID NO: 2594)
              3'-UGGUUCAAGGACCUUUUACUUCUGUCU-5'  (SEQ ID NO: 2314)
AAT-1176 Target: 5'-ACCAAGTTCCTGGAAAATGAAGACAGA-3' (SEQ ID NO: 2454)

5'-CCAUUACUGGAACCUAUGAUCUGAA-3'     (SEQ ID NO: 2595)
              3'-CAGGUAAUGACCUUGGAUACUAGACUU-5'  (SEQ ID NO: 2315)
AAT-1232 Target: 5'-GTCCATTACTGGAACCTATGATCTGAA-3' (SEQ ID NO: 2455)

5'-CAUUACUGGAACCUAUGAUCUGAAG-3'     (SEQ ID NO: 2596)
              3'-AGGUAAUGACCUUGGAUACUAGACUUC-5'  (SEQ ID NO: 2316)
AAT-1233 Target: 5'-TCCATTACTGGAACCTATGATCTGAAG-3' (SEQ ID NO: 2456)

5'-AUUACUGGAACCUAUGAUCUGAAGA-3'     (SEQ ID NO: 2597)
              3'-GGUAAUGACCUUGGAUACUAGACUUCU-5'  (SEQ ID NO: 2317)
AAT-1234 Target: 5'-CCATTACTGGAACCTATGATCTGAAGA-3' (SEQ ID NO: 2457)

5'-UUACUGGAACCUAUGAUCUGAAGAG-3'     (SEQ ID NO: 2598)
              3'-GUAAUGACCUUGGAUACUAGACUUCUC-5'  (SEQ ID NO: 2318)
AAT-1235 Target: 5'-CATTACTGGAACCTATGATCTGAAGAG-3' (SEQ ID NO: 2458)

5'-UACUGGAACCUAUGAUCUGAAGAGC-3'     (SEQ ID NO: 2599)
              3'-UAAUGACCUUGGAUACUAGACUUCUCG-5'  (SEQ ID NO: 2319)
AAT-1236 Target: 5'-ATTACTGGAACCTATGATCTGAAGAGC-3' (SEQ ID NO: 2459)

5'-ACUGGAACCUAUGAUCUGAAGAGCG-3'     (SEQ ID NO: 2600)
              3'-AAUGACCUUGGAUACUAGACUUCUCGC-5'  (SEQ ID NO: 2320)
AAT-1237 Target: 5'-TTACTGGAACCTATGATCTGAAGAGCG-3' (SEQ ID NO: 2460)

5'-CUGGAACCUAUGAUCUGAAGAGCGU-3'     (SEQ ID NO: 2601)
              3'-AUGACCUUGGAUACUAGACUUCUCGCA-5'  (SEQ ID NO: 2321)
AAT-1238 Target: 5'-TACTGGAACCTATGATCTGAAGAGCGT-3' (SEQ ID NO: 2461)

5'-UGGAACCUAUGAUCUGAAGAGCGUC-3'     (SEQ ID NO: 2602)
              3'-UGACCUUGGAUACUAGACUUCUCGCAG-5'  (SEQ ID NO: 2322)
AAT-1239 Target: 5'-ACTGGAACCTATGATCTGAAGAGCGTC-3' (SEQ ID NO: 2462)
```

TABLE 13-continued

Further Human Anti-α-1 antitrypsin DsiRNAs, Unmodified Duplexes
(Asymmetrics)

```
              5'-GGAACCUAUGAUCUGAAGAGCGUCC-3'     (SEQ ID NO: 2603)
              3'-GACCUUGGAUACUAGACUUCUCGCAGG-5'   (SEQ ID NO: 2323)
AAT-1240 Target: 5'-CTGGAACCTATGATCTGAAGAGCGTCC-3' (SEQ ID NO: 2463)

5'-AUCACUAAGGUCUUCAGCAAUGGGG-3'     (SEQ ID NO: 2604)
              3'-CGUAGUGAUUCCAGAAGUCGUUACCCC-5'   (SEQ ID NO: 2324)
AAT-1279 Target: 5'-GCATCACTAAGGTCTTCAGCAATGGGG-3' (SEQ ID NO: 2464)

5'-UCACUAAGGUCUUCAGCAAUGGGGC-3'     (SEQ ID NO: 2605)
              3'-GUAGUGAUUCCAGAAGUCGUUACCCCG-5'   (SEQ ID NO: 2325)
AAT-1280 Target: 5'-CATCACTAAGGTCTTCAGCAATGGGGC-3' (SEQ ID NO: 2465)

5'-CACUAAGGUCUUCAGCAAUGGGGCU-3'     (SEQ ID NO: 2606)
              3'-UAGUGAUUCCAGAAGUCGUUACCCCGA-5'   (SEQ ID NO: 2326)
AAT-1281 Target: 5'-ATCACTAAGGTCTTCAGCAATGGGGCT-3' (SEQ ID NO: 2466)

5'-CUAAGGUCUUCAGCAAUGGGGCUGA-3'     (SEQ ID NO: 2607)
              3'-GUGAUUCCAGAAGUCGUUACCCCGACU-5'   (SEQ ID NO: 2327)
AAT-1283 Target: 5'-CACTAAGGTCTTCAGCAATGGGGCTGA-3' (SEQ ID NO: 2467)

5'-UAAGGUCUUCAGCAAUGGGGCUGAC-3'     (SEQ ID NO: 2608)
              3'-UGAUUCCAGAAGUCGUUACCCCGACUG-5'   (SEQ ID NO: 2328)
AAT-1284 Target: 5'-ACTAAGGTCTTCAGCAATGGGGCTGAC-3' (SEQ ID NO: 2468)

5'-UGAAGCUCUCCAAGGCCGUGCAUAA-3'     (SEQ ID NO: 2609)
              3'-GGACUUCGAGAGGUUCCGGCACGUAUU-5'   (SEQ ID NO: 2329)
AAT-1337 Target: 5'-CCTGAAGCTCTCCAAGGCCGTGCATAA-3' (SEQ ID NO: 2469)

5'-GAAGCUCUCCAAGGCCGUGCAUAAG-3'     (SEQ ID NO: 2610)
              3'-GACUUCGAGAGGUUCCGGCACGUAUUC-5'   (SEQ ID NO: 2330)
AAT-1338 Target: 5'-CTGAAGCTCTCCAAGGCCGTGCATAAG-3' (SEQ ID NO: 2470)

5'-AAGCUCUCCAAGGCCGUGCAUAAGG-3'     (SEQ ID NO: 2611)
              3'-ACUUCGAGAGGUUCCGGCACGUAUUCC-5'   (SEQ ID NO: 2331)
AAT-1339 Target: 5'-TGAAGCTCTCCAAGGCCGTGCATAAGG-3' (SEQ ID NO: 2471)

5'-CCGAGGUCAAGUUCAACAAACCCUU-3'     (SEQ ID NO: 2612)
              3'-GGGGCUCCAGUUCAAGUUGUUUGGGAA-5'   (SEQ ID NO: 2332)
AAT-1442 Target: 5'-CCCCGAGGTCAAGTTCAACAAACCCTT-3' (SEQ ID NO: 2472)

5'-CGAGGUCAAGUUCAACAAACCCUUU-3'     (SEQ ID NO: 2613)
              3'-GGGCUCCAGUUCAAGUUGUUUGGGAAA-5'   (SEQ ID NO: 2333)
AAT-1443 Target: 5'-CCCGAGGTCAAGTTCAACAAACCCTTT-3' (SEQ ID NO: 2473)

5'-GAGGUCAAGUUCAACAAACCCUUUG-3'     (SEQ ID NO: 2614)
              3'-GGCUCCAGUUCAAGUUGUUUGGGAAAC-5'   (SEQ ID NO: 2334)
AAT-1444 Target: 5'-CCGAGGTCAAGTTCAACAAACCCTTTG-3' (SEQ ID NO: 2474)

5'-AGGUCAAGUUCAACAAACCCUUUGU-3'     (SEQ ID NO: 2615)
              3'-GCUCCAGUUCAAGUUGUUUGGGAAACA-5'   (SEQ ID NO: 2335)
AAT-1445 Target: 5'-CGAGGTCAAGTTCAACAAACCCTTTGT-3' (SEQ ID NO: 2475)

5'-GGUCAAGUUCAACAAACCCUUUGUC-3'     (SEQ ID NO: 2616)
              3'-CUCCAGUUCAAGUUGUUUGGGAAACAG-5'   (SEQ ID NO: 2336)
AAT-1446 Target: 5'-GAGGTCAAGTTCAACAAACCCTTTGTC-3' (SEQ ID NO: 2476)

5'-GUCAAGUUCAACAAACCCUUUGUCU-3'     (SEQ ID NO: 2617)
              3'-UCCAGUUCAAGUUGUUUGGGAAACAGA-5'   (SEQ ID NO: 2337)
AAT-1447 Target: 5'-AGGTCAAGTTCAACAAACCCTTTGTCT-3' (SEQ ID NO: 2477)

5'-UCAAGUUCAACAAACCCUUUGUCUU-3'     (SEQ ID NO: 2618)
              3'-CCAGUUCAAGUUGUUUGGGAAACAGAA-5'   (SEQ ID NO: 2338)
AAT-1448 Target: 5'-GGTCAAGTTCAACAAACCCTTTGTCTT-3' (SEQ ID NO: 2478)

5'-CAAGUUCAACAAACCCUUUGUCUUC-3'     (SEQ ID NO: 2619)
              3'-CAGUUCAAGUUGUUUGGGAAACAGAAG-5'   (SEQ ID NO: 2339)
AAT-1449 Target: 5'-GTCAAGTTCAACAAACCCTTTGTCTTC-3' (SEQ ID NO: 2479)

5'-AAGUUCAACAAACCCUUUGUCUUCU-3'     (SEQ ID NO: 2620)
              3'-AGUUCAAGUUGUUUGGGAAACAGAAGA-5'   (SEQ ID NO: 2340)
AAT-1450 Target: 5'-TCAAGTTCAACAAACCCTTTGTCTTCT-3' (SEQ ID NO: 2480)

5'-AGUUCAACAAACCCUUUGUCUUCUU-3'     (SEQ ID NO: 2621)
              3'-GUUCAAGUUGUUUGGGAAACAGAAGAA-5'   (SEQ ID NO: 2341)
AAT-1451 Target: 5'-CAAGTTCAACAAACCCTTTGTCTTCTT-3' (SEQ ID NO: 2481)
```

TABLE 14

Further DsiRNA Target Sequences (21mers) in α-1 antitrypsin mRNA

| | | | |
|---|---|---|---|
| AAT-366 21 nt Target: | 5'-CCCCAGGGAGAUGCUGCCCAG-3' | (SEQ ID NO: 2622) |
| AAT-367 21 nt Target: | 5'-CCCAGGGAGAUGCUGCCCAGA-3' | (SEQ ID NO: 2623) |
| AAT-368 21 nt Target: | 5'-CCAGGGAGAUGCUGCCCAGAA-3' | (SEQ ID NO: 2624) |
| AAT-369 21 nt Target: | 5'-CAGGGAGAUGCUGCCCAGAAG-3' | (SEQ ID NO: 2625) |
| AAT-370 21 nt Target: | 5'-AGGGAGAUGCUGCCCAGAAGA-3' | (SEQ ID NO: 2626) |
| AAT-371 21 nt Target: | 5'-GGGAGAUGCUGCCCAGAAGAC-3' | (SEQ ID NO: 2627) |
| AAT-391 21 nt Target: | 5'-CAGAUACAUCCCACCAUGAUC-3' | (SEQ ID NO: 2628) |
| AAT-392 21 nt Target: | 5'-AGAUACAUCCCACCAUGAUCA-3' | (SEQ ID NO: 2629) |
| AAT-393 21 nt Target: | 5'-GAUACAUCCCACCAUGAUCAG-3' | (SEQ ID NO: 2630) |
| AAT-394 21 nt Target: | 5'-AUACAUCCCACCAUGAUCAGG-3' | (SEQ ID NO: 2631) |
| AAT-485 21 nt Target: | 5'-ACACCAGUCCAACAGCACCAA-3' | (SEQ ID NO: 2632) |
| AAT-486 21 nt Target: | 5'-CACCAGUCCAACAGCACCAAU-3' | (SEQ ID NO: 2633) |
| AAT-487 21 nt Target: | 5'-ACCAGUCCAACAGCACCAAUA-3' | (SEQ ID NO: 2634) |
| AAT-488 21 nt Target: | 5'-CCAGUCCAACAGCACCAAUAU-3' | (SEQ ID NO: 2635) |
| AAT-489 21 nt Target: | 5'-CAGUCCAACAGCACCAAUAUC-3' | (SEQ ID NO: 2636) |
| AAT-490 21 nt Target: | 5'-AGUCCAACAGCACCAAUAUCU-3' | (SEQ ID NO: 2637) |
| AAT-491 21 nt Target: | 5'-GUCCAACAGCACCAAUAUCUU-3' | (SEQ ID NO: 2638) |
| AAT-492 21 nt Target: | 5'-UCCAACAGCACCAAUAUCUUC-3' | (SEQ ID NO: 2639) |
| AAT-493 21 nt Target: | 5'-CCAACAGCACCAAUAUCUUCU-3' | (SEQ ID NO: 2640) |
| AAT-494 21 nt Target: | 5'-CAACAGCACCAAUAUCUUCUU-3' | (SEQ ID NO: 2641) |
| AAT-495 21 nt Target: | 5'-AACAGCACCAAUAUCUUCUUC-3' | (SEQ ID NO: 2642) |
| AAT-496 21 nt Target: | 5'-ACAGCACCAAUAUCUUCUUCU-3' | (SEQ ID NO: 2643) |
| AAT-497 21 nt Target: | 5'-CAGCACCAAUAUCUUCUUCUC-3' | (SEQ ID NO: 2644) |
| AAT-498 21 nt Target: | 5'-AGCACCAAUAUCUUCUUCUCC-3' | (SEQ ID NO: 2645) |
| AAT-499 21 nt Target: | 5'-GCACCAAUAUCUUCUUCUCCC-3' | (SEQ ID NO: 2646) |
| AAT-516 21 nt Target: | 5'-UCCCCAGUGAGCAUCGCUACA-3' | (SEQ ID NO: 2647) |
| AAT-517 21 nt Target: | 5'-CCCCAGUGAGCAUCGCUACAG-3' | (SEQ ID NO: 2648) |
| AAT-518 21 nt Target: | 5'-CCCAGUGAGCAUCGCUACAGC-3' | (SEQ ID NO: 2649) |
| AAT-519 21 nt Target: | 5'-CCAGUGAGCAUCGCUACAGCC-3' | (SEQ ID NO: 2650) |
| AAT-520 21 nt Target: | 5'-CAGUGAGCAUCGCUACAGCCU-3' | (SEQ ID NO: 2651) |
| AAT-521 21 nt Target: | 5'-AGUGAGCAUCGCUACAGCCUU-3' | (SEQ ID NO: 2652) |
| AAT-522 21 nt Target: | 5'-GUGAGCAUCGCUACAGCCUUU-3' | (SEQ ID NO: 2653) |
| AAT-523 21 nt Target: | 5'-UGAGCAUCGCUACAGCCUUUG-3' | (SEQ ID NO: 2654) |
| AAT-524 21 nt Target: | 5'-GAGCAUCGCUACAGCCUUUGC-3' | (SEQ ID NO: 2655) |
| AAT-525 21 nt Target: | 5'-AGCAUCGCUACAGCCUUUGCA-3' | (SEQ ID NO: 2656) |
| AAT-526 21 nt Target: | 5'-GCAUCGCUACAGCCUUUGCAA-3' | (SEQ ID NO: 2657) |
| AAT-527 21 nt Target: | 5'-CAUCGCUACAGCCUUUGCAAU-3' | (SEQ ID NO: 2658) |
| AAT-528 21 nt Target: | 5'-AUCGCUACAGCCUUUGCAAUG-3' | (SEQ ID NO: 2659) |
| AAT-529 21 nt Target: | 5'-UCGCUACAGCCUUUGCAAUGC-3' | (SEQ ID NO: 2660) |

TABLE 14-continued

Further DsiRNA Target Sequences (21mers) in α-1 antitrypsin mRNA

| | | | |
|---|---|---|---|
| AAT-530 21 nt Target: | 5'-CGCUACAGCCUUUGCAAUGCU-3' | (SEQ ID NO: 2661) |
| AAT-531 21 nt Target: | 5'-GCUACAGCCUUUGCAAUGCUC-3' | (SEQ ID NO: 2662) |
| AAT-552 21 nt Target: | 5'-UCCCUGGGGACCAAGGCUGAC-3' | (SEQ ID NO: 2663) |
| AAT-556 21 nt Target: | 5'-UGGGGACCAAGGCUGACACUC-3' | (SEQ ID NO: 2664) |
| AAT-557 21 nt Target: | 5'-GGGGACCAAGGCUGACACUCA-3' | (SEQ ID NO: 2665) |
| AAT-558 21 nt Target: | 5'-GGGACCAAGGCUGACACUCAC-3' | (SEQ ID NO: 2666) |
| AAT-579 21 nt Target: | 5'-GAUGAAAUCCUGGAGGGCCUG-3' | (SEQ ID NO: 2667) |
| AAT-580 21 nt Target: | 5'-AUGAAAUCCUGGAGGGCCUGA-3' | (SEQ ID NO: 2668) |
| AAT-632 21 nt Target: | 5'-GAUCCAUGAAGGCUUCCAGGA-3' | (SEQ ID NO: 2669) |
| AAT-633 21 nt Target: | 5'-AUCCAUGAAGGCUUCCAGGAA-3' | (SEQ ID NO: 2670) |
| AAT-801 21 nt Target: | 5'-GGGGACACCGAAGAGGCCAAG-3' | (SEQ ID NO: 2671) |
| AAT-802 21 nt Target: | 5'-GGGACACCGAAGAGGCCAAGA-3' | (SEQ ID NO: 2672) |
| AAT-803 21 nt Target: | 5'-GGACACCGAAGAGGCCAAGAA-3' | (SEQ ID NO: 2673) |
| AAT-804 21 nt Target: | 5'-GACACCGAAGAGGCCAAGAAA-3' | (SEQ ID NO: 2674) |
| AAT-805 21 nt Target: | 5'-ACACCGAAGAGGCCAAGAAAC-3' | (SEQ ID NO: 2675) |
| AAT-806 21 nt Target: | 5'-CACCGAAGAGGCCAAGAAACA-3' | (SEQ ID NO: 2676) |
| AAT-807 21 nt Target: | 5'-ACCGAAGAGGCCAAGAAACAG-3' | (SEQ ID NO: 2677) |
| AAT-808 21 nt Target: | 5'-CCGAAGAGGCCAAGAAACAGA-3' | (SEQ ID NO: 2678) |
| AAT-809 21 nt Target: | 5'-CGAAGAGGCCAAGAAACAGAU-3' | (SEQ ID NO: 2679) |
| AAT-810 21 nt Target: | 5'-GAAGAGGCCAAGAAACAGAUC-3' | (SEQ ID NO: 2680) |
| AAT-811 21 nt Target: | 5'-AAGAGGCCAAGAAACAGAUCA-3' | (SEQ ID NO: 2681) |
| AAT-812 21 nt Target: | 5'-AGAGGCCAAGAAACAGAUCAA-3' | (SEQ ID NO: 2682) |
| AAT-813 21 nt Target: | 5'-GAGGCCAAGAAACAGAUCAAC-3' | (SEQ ID NO: 2683) |
| AAT-900 21 nt Target: | 5'-GUUUUUGCUCUGGUGAAUUAC-3' | (SEQ ID NO: 2684) |
| AAT-901 21 nt Target: | 5'-UUUUUGCUCUGGUGAAUUACA-3' | (SEQ ID NO: 2685) |
| AAT-902 21 nt Target: | 5'-UUUUGCUCUGGUGAAUUACAU-3' | (SEQ ID NO: 2686) |
| AAT-903 21 nt Target: | 5'-UUUGCUCUGGUGAAUUACAUC-3' | (SEQ ID NO: 2687) |
| AAT-904 21 nt Target: | 5'-UUGCUCUGGUGAAUUACAUCU-3' | (SEQ ID NO: 2688) |
| AAT-905 21 nt Target: | 5'-UGCUCUGGUGAAUUACAUCUU-3' | (SEQ ID NO: 2689) |
| AAT-906 21 nt Target: | 5'-GCUCUGGUGAAUUACAUCUUC-3' | (SEQ ID NO: 2690) |
| AAT-907 21 nt Target: | 5'-CUCUGGUGAAUUACAUCUUCU-3' | (SEQ ID NO: 2691) |
| AAT-908 21 nt Target: | 5'-UCUGGUGAAUUACAUCUUCUU-3' | (SEQ ID NO: 2692) |
| AAT-909 21 nt Target: | 5'-CUGGUGAAUUACAUCUUCUUU-3' | (SEQ ID NO: 2693) |
| AAT-910 21 nt Target: | 5'-UGGUGAAUUACAUCUUCUUUA-3' | (SEQ ID NO: 2694) |
| AAT-911 21 nt Target: | 5'-GGUGAAUUACAUCUUCUUUAA-3' | (SEQ ID NO: 2695) |
| AAT-912 21 nt Target: | 5'-GUGAAUUACAUCUUCUUUAAA-3' | (SEQ ID NO: 2696) |
| AAT-913 21 nt Target: | 5'-UGAAUUACAUCUUCUUUAAAG-3' | (SEQ ID NO: 2697) |
| AAT-914 21 nt Target: | 5'-GAAUUACAUCUUCUUUAAAGG-3' | (SEQ ID NO: 2698) |
| AAT-915 21 nt Target: | 5'-AAUUACAUCUUCUUUAAAGGC-3' | (SEQ ID NO: 2699) |

TABLE 14-continued

Further DsiRNA Target Sequences (21mers) in α-1 antitrypsin mRNA

| | | |
|---|---|---|
| AAT-916 21 nt Target: | 5'-AUUACAUCUUCUUUAAAGGCA-3' | (SEQ ID NO: 2700) |
| AAT-917 21 nt Target: | 5'-UUACAUCUUCUUUAAAGGCAA-3' | (SEQ ID NO: 2701) |
| AAT-918 21 nt Target: | 5'-UACAUCUUCUUUAAAGGCAAA-3' | (SEQ ID NO: 2702) |
| AAT-922 21 nt Target: | 5'-UCUUCUUUAAAGGCAAAUGGG-3' | (SEQ ID NO: 2703) |
| AAT-924 21 nt Target: | 5'-UUCUUUAAAGGCAAAUGGGAG-3' | (SEQ ID NO: 2704) |
| AAT-932 21 nt Target: | 5'-AGGCAAAUGGGAGAGACCCUU-3' | (SEQ ID NO: 2705) |
| AAT-933 21 nt Target: | 5'-GGCAAAUGGGAGAGACCCUUU-3' | (SEQ ID NO: 2706) |
| AAT-934 21 nt Target: | 5'-GCAAAUGGGAGAGACCCUUUG-3' | (SEQ ID NO: 2707) |
| AAT-935 21 nt Target: | 5'-CAAAUGGGAGAGACCCUUUGA-3' | (SEQ ID NO: 2708) |
| AAT-1061 21 nt Target: | 5'-GCUGUCCAGCUGGGUGCUGCU-3' | (SEQ ID NO: 2709) |
| AAT-1062 21 nt Target: | 5'-CUGUCCAGCUGGGUGCUGCUG-3' | (SEQ ID NO: 2710) |
| AAT-1063 21 nt Target: | 5'-UGUCCAGCUGGGUGCUGCUGA-3' | (SEQ ID NO: 2711) |
| AAT-1064 21 nt Target: | 5'-GUCCAGCUGGGUGCUGCUGAU-3' | (SEQ ID NO: 2712) |
| AAT-1065 21 nt Target: | 5'-UCCAGCUGGGUGCUGCUGAUG-3' | (SEQ ID NO: 2713) |
| AAT-1066 21 nt Target: | 5'-CCAGCUGGGUGCUGCUGAUGA-3' | (SEQ ID NO: 2714) |
| AAT-1067 21 nt Target: | 5'-CAGCUGGGUGCUGCUGAUGAA-3' | (SEQ ID NO: 2715) |
| AAT-1068 21 nt Target: | 5'-AGCUGGGUGCUGCUGAUGAAA-3' | (SEQ ID NO: 2716) |
| AAT-1069 21 nt Target: | 5'-GCUGGGUGCUGCUGAUGAAAU-3' | (SEQ ID NO: 2717) |
| AAT-1070 21 nt Target: | 5'-CUGGGUGCUGCUGAUGAAAUA-3' | (SEQ ID NO: 2718) |
| AAT-1072 21 nt Target: | 5'-GGGUGCUGCUGAUGAAAUACC-3' | (SEQ ID NO: 2719) |
| AAT-1073 21 nt Target: | 5'-GGUGCUGCUGAUGAAAUACCU-3' | (SEQ ID NO: 2720) |
| AAT-1074 21 nt Target: | 5'-GUGCUGCUGAUGAAAUACCUG-3' | (SEQ ID NO: 2721) |
| AAT-1075 21 nt Target: | 5'-UGCUGCUGAUGAAAUACCUGG-3' | (SEQ ID NO: 2722) |
| AAT-1076 21 nt Target: | 5'-GCUGCUGAUGAAAUACCUGGG-3' | (SEQ ID NO: 2723) |
| AAT-1077 21 nt Target: | 5'-CUGCUGAUGAAAUACCUGGGC-3' | (SEQ ID NO: 2724) |
| AAT-1078 21 nt Target: | 5'-UGCUGAUGAAAUACCUGGGCA-3' | (SEQ ID NO: 2725) |
| AAT-1079 21 nt Target: | 5'-GCUGAUGAAAUACCUGGGCAA-3' | (SEQ ID NO: 2726) |
| AAT-1080 21 nt Target: | 5'-CUGAUGAAAUACCUGGGCAAU-3' | (SEQ ID NO: 2727) |
| AAT-1081 21 nt Target: | 5'-UGAUGAAAUACCUGGGCAAUG-3' | (SEQ ID NO: 2728) |
| AAT-1083 21 nt Target: | 5'-AUGAAAUACCUGGGCAAUGCC-3' | (SEQ ID NO: 2729) |
| AAT-1138 21 nt Target: | 5'-UACAGCACCUGGAAAAUGAAC-3' | (SEQ ID NO: 2730) |
| AAT-1144 21 nt Target: | 5'-ACCUGGAAAAUGAACUCACCC-3' | (SEQ ID NO: 2731) |
| AAT-1145 21 nt Target: | 5'-CCUGGAAAAUGAACUCACCCA-3' | (SEQ ID NO: 2732) |
| AAT-1165 21 nt Target: | 5'-ACGAUAUCAUCACCAAGUUCC-3' | (SEQ ID NO: 2733) |
| AAT-1176 21 nt Target: | 5'-ACCAAGUUCCUGGAAAAUGAA-3' | (SEQ ID NO: 2734) |
| AAT-1232 21 nt Target: | 5'-GUCCAUUACUGGAACCUAUGA-3' | (SEQ ID NO: 2735) |
| AAT-1233 21 nt Target: | 5'-UCCAUUACUGGAACCUAUGAU-3' | (SEQ ID NO: 2736) |
| AAT-1234 21 nt Target: | 5'-CCAUUACUGGAACCUAUGAUC-3' | (SEQ ID NO: 2737) |
| AAT-1235 21 nt Target: | 5'-CAUUACUGGAACCUAUGAUCU-3' | (SEQ ID NO: 2738) |

TABLE 14-continued

Further DsiRNA Target Sequences (21mers) in α-1 antitrypsin mRNA

| | |
|---|---|
| AAT-1236 21 nt Target: 5'-AUUACUGGAACCUAUGAUCUG-3' | (SEQ ID NO: 2739) |
| AAT-1237 21 nt Target: 5'-UUACUGGAACCUAUGAUCUGA-3' | (SEQ ID NO: 2740) |
| AAT-1238 21 nt Target: 5'-UACUGGAACCUAUGAUCUGAA-3' | (SEQ ID NO: 2741) |
| AAT-1239 21 nt Target: 5'-ACUGGAACCUAUGAUCUGAAG-3' | (SEQ ID NO: 2742) |
| AAT-1240 21 nt Target: 5'-CUGGAACCUAUGAUCUGAAGA-3' | (SEQ ID NO: 2743) |
| AAT-1279 21 nt Target: 5'-GCAUCACUAAGGUCUUCAGCA-3' | (SEQ ID NO: 2744) |
| AAT-1280 21 nt Target: 5'-CAUCACUAAGGUCUUCAGCAA-3' | (SEQ ID NO: 2745) |
| AAT-1281 21 nt Target: 5'-AUCACUAAGGUCUUCAGCAAU-3' | (SEQ ID NO: 2746) |
| AAT-1283 21 nt Target: 5'-CACUAAGGUCUUCAGCAAUGG-3' | (SEQ ID NO: 2747) |
| AAT-1284 21 nt Target: 5'-ACUAAGGUCUUCAGCAAUGGG-3' | (SEQ ID NO: 2748) |
| AAT-1337 21 nt Target: 5'-CCUGAAGCUCUCCAAGGCCGU-3' | (SEQ ID NO: 2749) |
| AAT-1338 21 nt Target: 5'-CUGAAGCUCUCCAAGGCCGUG-3' | (SEQ ID NO: 2750) |
| AAT-1339 21 nt Target: 5'-UGAAGCUCUCCAAGGCCGUGC-3' | (SEQ ID NO: 2751) |
| AAT-1442 21 nt Target: 5'-CCCCGAGGUCAAGUUCAACAA-3' | (SEQ ID NO: 2752) |
| AAT-1443 21 nt Target: 5'-CCCGAGGUCAAGUUCAACAAA-3' | (SEQ ID NO: 2753) |
| AAT-1444 21 nt Target: 5'-CCGAGGUCAAGUUCAACAAAC-3' | (SEQ ID NO: 2754) |
| AAT-1445 21 nt Target: 5'-CGAGGUCAAGUUCAACAAACC-3' | (SEQ ID NO: 2755) |
| AAT-1446 21 nt Target: 5'-GAGGUCAAGUUCAACAAACCC-3' | (SEQ ID NO: 2756) |
| AAT-1447 21 nt Target: 5'-AGGUCAAGUUCAACAAACCCU-3' | (SEQ ID NO: 2757) |
| AAT-1448 21 nt Target: 5'-GGUCAAGUUCAACAAACCCUU-3' | (SEQ ID NO: 2758) |
| AAT-1449 21 nt Target: 5'-GUCAAGUUCAACAAACCCUUU-3' | (SEQ ID NO: 2759) |
| AAT-1450 21 nt Target: 5'-UCAAGUUCAACAAACCCUUUG-3' | (SEQ ID NO: 2760) |
| AAT-1451 21 nt Target: 5'-CAAGUUCAACAAACCCUUUGU-3' | (SEQ ID NO: 2761) |

TABLE 15

Further Human Anti-α-1 antitrypsin "Blunt/Blunt" DsiRNAs

| | | |
|---|---|---|
| | 5'-CCCCAGGGAGAUGCUGCCCAGAAGACA-3' | (SEQ ID NO: 2762) |
| | 3'-GGGGUCCCUCUACGACGGGUCUUCUGU-5' | (SEQ ID NO: 2202) |
| AAT-366 Target: | 5'-CCCCAGGGAGATGCTGCCCAGAAGACA-3' | (SEQ ID NO: 2342) |
| | 5'-CCCAGGGAGAUGCUGCCCAGAAGACAG-3' | (SEQ ID NO: 2763) |
| | 3'-GGGUCCCUCUACGACGGGUCUUCUGUC-5' | (SEQ ID NO: 2203) |
| AAT-367 Target: | 5'-CCCAGGGAGATGCTGCCCAGAAGACAG-3' | (SEQ ID NO: 2343) |
| | 5'-CCAGGGAGAUGCUGCCCAGAAGACAGA-3' | (SEQ ID NO: 2764) |
| | 3'-GGUCCCUCUACGACGGGUCUUCUGUCU-5' | (SEQ ID NO: 2204) |
| AAT-368 Target: | 5'-CCAGGGAGATGCTGCCCAGAAGACAGA-3' | (SEQ ID NO: 2344) |
| | 5'-CAGGGAGAUGCUGCCCAGAAGACAGAU-3' | (SEQ ID NO: 2765) |
| | 3'-GUCCCUCUACGACGGGUCUUCUGUCUA-5' | (SEQ ID NO: 2205) |
| AAT-369 Target: | 5'-CAGGGAGATGCTGCCCAGAAGACAGAT-3' | (SEQ ID NO: 2345) |
| | 5'-AGGGAGAUGCUGCCCAGAAGACAGAUA-3' | (SEQ ID NO: 2766) |
| | 3'-UCCCUCUACGACGGGUCUUCUGUCUAU-5' | (SEQ ID NO: 2206) |
| AAT-370 Target: | 5'-AGGGAGATGCTGCCCAGAAGACAGATA-3' | (SEQ ID NO: 2346) |
| | 5'-GGGAGAUGCUGCCCAGAAGACAGAUAC-3' | (SEQ ID NO: 2767) |
| | 3'-CCCUCUACGACGGGUCUUCUGUCUAUG-5' | (SEQ ID NO: 2207) |
| AAT-371 Target: | 5'-GGGAGATGCTGCCCAGAAGACAGATAC-3' | (SEQ ID NO: 2347) |

TABLE 15-continued

Further Human Anti-α-1 antitrypsin "Blunt/Blunt" DsiRNAs

```
                5'-CAGAUACAUCCCACCAUGAUCAGGAUC-3'    (SEQ ID NO: 2768)
                3'-GUCUAUGUAGGGUGGUACUAGUCCUAG-5'    (SEQ ID NO: 2208)
AAT-391 Target: 5'-CAGATACATCCCACCATGATCAGGATC-3'    (SEQ ID NO: 2348)

5'-AGAUACAUCCCACCAUGAUCAGGAUCA-3'    (SEQ ID NO: 2769)
                3'-UCUAUGUAGGGUGGUACUAGUCCUAGU-5'    (SEQ ID NO: 2209)
AAT-392 Target: 5'-AGATACATCCCACCATGATCAGGATCA-3'    (SEQ ID NO: 2349)

5'-GAUACAUCCCACCAUGAUCAGGAUCAC-3'    (SEQ ID NO: 2770)
                3'-CUAUGUAGGGUGGUACUAGUCCUAGUG-5'    (SEQ ID NO: 2210)
AAT-393 Target: 5'-GATACATCCCACCATGATCAGGATCAC-3'    (SEQ ID NO: 2350)

5'-AUACAUCCCACCAUGAUCAGGAUCACC-3'    (SEQ ID NO: 2771)
                3'-UAUGUAGGGUGGUACUAGUCCUAGUGG-5'    (SEQ ID NO: 2211)
AAT-394 Target: 5'-ATACATCCCACCATGATCAGGATCACC-3'    (SEQ ID NO: 2351)

5'-ACACCAGUCCAACAGCACCAAUAUCUU-3'    (SEQ ID NO: 2772)
                3'-UGUGGUCAGGUUGUCGUGGUUAUAGAA-5'    (SEQ ID NO: 2212)
AAT-485 Target: 5'-ACACCAGTCCAACAGCACCAATATCTT-3'    (SEQ ID NO: 2352)

5'-CACCAGUCCAACAGCACCAAUAUCUUC-3'    (SEQ ID NO: 2773)
                3'-GUGGUCAGGUUGUCGUGGUUAUAGAAG-5'    (SEQ ID NO: 2213)
AAT-486 Target: 5'-CACCAGTCCAACAGCACCAATATCTTC-3'    (SEQ ID NO: 2353)

5'-ACCAGUCCAACAGCACCAAUAUCUUCU-3'    (SEQ ID NO: 2774)
                3'-UGGUCAGGUUGUCGUGGUUAUAGAAGA-5'    (SEQ ID NO: 2214)
AAT-487 Target: 5'-ACCAGTCCAACAGCACCAATATCTTCT-3'    (SEQ ID NO: 2354)

5'-CCAGUCCAACAGCACCAAUAUCUUCUU-3'    (SEQ ID NO: 2775)
                3'-GGUCAGGUUGUCGUGGUUAUAGAAGAA-5'    (SEQ ID NO: 2215)
AAT-488 Target: 5'-CCAGTCCAACAGCACCAATATCTTCTT-3'    (SEQ ID NO: 2355)

5'-CAGUCCAACAGCACCAAUAUCUUCUUC-3'    (SEQ ID NO: 2776)
                3'-GUCAGGUUGUCGUGGUUAUAGAAGAAG-5'    (SEQ ID NO: 2216)
AAT-489 Target: 5'-CAGTCCAACAGCACCAATATCTTCTTC-3'    (SEQ ID NO: 2356)

5'-AGUCCAACAGCACCAAUAUCUUCUUCU-3'    (SEQ ID NO: 2777)
                3'-UCAGGUUGUCGUGGUUAUAGAAGAAGA-5'    (SEQ ID NO: 2217)
AAT-490 Target: 5'-AGTCCAACAGCACCAATATCTTCTTCT-3'    (SEQ ID NO: 2357)

5'-GUCCAACAGCACCAAUAUCUUCUUCUC-3'    (SEQ ID NO: 2778)
                3'-CAGGUUGUCGUGGUUAUAGAAGAAGAG-5'    (SEQ ID NO: 2218)
AAT-491 Target: 5'-GTCCAACAGCACCAATATCTTCTTCTC-3'    (SEQ ID NO: 2358)

5'-UCCAACAGCACCAAUAUCUUCUUCUCC-3'    (SEQ ID NO: 2779)
                3'-AGGUUGUCGUGGUUAUAGAAGAAGAGG-5'    (SEQ ID NO: 2219)
AAT-492 Target: 5'-TCCAACAGCACCAATATCTTCTTCTCC-3'    (SEQ ID NO: 2359)

5'-CCAACAGCACCAAUAUCUUCUUCUCCC-3'    (SEQ ID NO: 2780)
                3'-GGUUGUCGUGGUUAUAGAAGAAGAGGG-5'    (SEQ ID NO: 2220)
AAT-493 Target: 5'-CCAACAGCACCAATATCTTCTTCTCCC-3'    (SEQ ID NO: 2360)

5'-CAACAGCACCAAUAUCUUCUUCUCCCC-3'    (SEQ ID NO: 2781)
                3'-GUUGUCGUGGUUAUAGAAGAAGAGGGG-5'    (SEQ ID NO: 2221)
AAT-494 Target: 5'-CAACAGCACCAATATCTTCTTCTCCCC-3'    (SEQ ID NO: 2361)

5'-AACAGCACCAAUAUCUUCUUCUCCCCA-3'    (SEQ ID NO: 2782)
                3'-UUGUCGUGGUUAUAGAAGAAGAGGGGU-5'    (SEQ ID NO: 2222)
AAT-495 Target: 5'-AACAGCACCAATATCTTCTTCTCCCCA-3'    (SEQ ID NO: 2362)

5'-ACAGCACCAAUAUCUUCUUCUCCCCAG-3'    (SEQ ID NO: 2783)
                3'-UGUCGUGGUUAUAGAAGAAGAGGGGUC-5'    (SEQ ID NO: 2223)
AAT-496 Target: 5'-ACAGCACCAATATCTTCTTCTCCCCAG-3'    (SEQ ID NO: 2363)

5'-CAGCACCAAUAUCUUCUUCUCCCCAGU-3'    (SEQ ID NO: 2784)
                3'-GUCGUGGUUAUAGAAGAAGAGGGGUCA-5'    (SEQ ID NO: 2224)
AAT-497 Target: 5'-CAGCACCAATATCTTCTTCTCCCCAGT-3'    (SEQ ID NO: 2364)

5'-AGCACCAAUAUCUUCUUCUCCCCAGUG-3'    (SEQ ID NO: 2785)
                3'-UCGUGGUUAUAGAAGAAGAGGGGUCAC-5'    (SEQ ID NO: 2225)
AAT-498 Target: 5'-AGCACCAATATCTTCTTCTCCCCAGTG-3'    (SEQ ID NO: 2365)

5'-GCACCAAUAUCUUCUUCUCCCCAGUGA-3'    (SEQ ID NO: 2786)
                3'-CGUGGUUAUAGAAGAAGAGGGGUCACU-5'    (SEQ ID NO: 2226)
AAT-499 Target: 5'-GCACCAATATCTTCTTCTCCCCAGTGA-3'    (SEQ ID NO: 2366)
```

TABLE 15-continued

Further Human Anti-α-1 antitrypsin "Blunt/Blunt" DsiRNAs

```
                5'-UCCCCAGUGAGCAUCGCUACAGCCUUU-3'   (SEQ ID NO: 2787)
                3'-AGGGGUCACUCGUAGCGAUGUCGGAAA-5'   (SEQ ID NO: 2227)
AAT-516 Target: 5'-TCCCCAGTGAGCATCGCTACAGCCTTT-3'   (SEQ ID NO: 2367)

5'-CCCCAGUGAGCAUCGCUACAGCCUUUG-3'   (SEQ ID NO: 2788)
                3'-GGGGUCACUCGUAGCGAUGUCGGAAAC-5'   (SEQ ID NO: 2228)
AAT-517 Target: 5'-CCCCAGTGAGCATCGCTACAGCCTTTG-3'   (SEQ ID NO: 2368)

5'-CCCAGUGAGCAUCGCUACAGCCUUUGC-3'   (SEQ ID NO: 2789)
                3'-GGGUCACUCGUAGCGAUGUCGGAAACG-5'   (SEQ ID NO: 2229)
AAT-518 Target: 5'-CCCAGTGAGCATCGCTACAGCCTTTGC-3'   (SEQ ID NO: 2369)

5'-CCAGUGAGCAUCGCUACAGCCUUUGCA-3'   (SEQ ID NO: 2790)
                3'-GGUCACUCGUAGCGAUGUCGGAAACGU-5'   (SEQ ID NO: 2230)
AAT-519 Target: 5'-CCAGTGAGCATCGCTACAGCCTTTGCA-3'   (SEQ ID NO: 2370)

5'-CAGUGAGCAUCGCUACAGCCUUUGCAA-3'   (SEQ ID NO: 2791)
                3'-GUCACUCGUAGCGAUGUCGGAAACGUU-5'   (SEQ ID NO: 2231)
AAT-520 Target: 5'-CAGTGAGCATCGCTACAGCCTTTGCAA-3'   (SEQ ID NO: 2371)

5'-AGUGAGCAUCGCUACAGCCUUUGCAAU-3'   (SEQ ID NO: 2792)
                3'-UCACUCGUAGCGAUGUCGGAAACGUUA-5'   (SEQ ID NO: 2232)
AAT-521 Target: 5'-AGTGAGCATCGCTACAGCCTTTGCAAT-3'   (SEQ ID NO: 2372)

5'-GUGAGCAUCGCUACAGCCUUUGCAAUG-3'   (SEQ ID NO: 2793)
                3'-CACUCGUAGCGAUGUCGGAAACGUUAC-5'   (SEQ ID NO: 2233)
AAT-522 Target: 5'-GTGAGCATCGCTACAGCCTTTGCAATG-3'   (SEQ ID NO: 2373)

5'-UGAGCAUCGCUACAGCCUUUGCAAUGC-3'   (SEQ ID NO: 2794)
                3'-ACUCGUAGCGAUGUCGGAAACGUUACG-5'   (SEQ ID NO: 2234)
AAT-523 Target: 5'-TGAGCATCGCTACAGCCTTTGCAATGC-3'   (SEQ ID NO: 2374)

5'-GAGCAUCGCUACAGCCUUUGCAAUGCU-3'   (SEQ ID NO: 2795)
                3'-CUCGUAGCGAUGUCGGAAACGUUACGA-5'   (SEQ ID NO: 2235)
AAT-524 Target: 5'-GAGCATCGCTACAGCCTTTGCAATGCT-3'   (SEQ ID NO: 2375)

5'-AGCAUCGCUACAGCCUUUGCAAUGCUC-3'   (SEQ ID NO: 2796)
                3'-UCGUAGCGAUGUCGGAAACGUUACGAG-5'   (SEQ ID NO: 2236)
AAT-525 Target: 5'-AGCATCGCTACAGCCTTTGCAATGCTC-3'   (SEQ ID NO: 2376)

5'-GCAUCGCUACAGCCUUUGCAAUGCUCU-3'   (SEQ ID NO: 2797)
                3'-CGUAGCGAUGUCGGAAACGUUACGAGA-5'   (SEQ ID NO: 2237)
AAT-526 Target: 5'-GCATCGCTACAGCCTTTGCAATGCTCT-3'   (SEQ ID NO: 2377)

5'-CAUCGCUACAGCCUUUGCAAUGCUCUC-3'   (SEQ ID NO: 2798)
                3'-GUAGCGAUGUCGGAAACGUUACGAGAG-5'   (SEQ ID NO: 2238)
AAT-527 Target: 5'-CATCGCTACAGCCTTTGCAATGCTCTC-3'   (SEQ ID NO: 2378)

5'-AUCGCUACAGCCUUUGCAAUGCUCUCC-3'   (SEQ ID NO: 2799)
                3'-UAGCGAUGUCGGAAACGUUACGAGAGG-5'   (SEQ ID NO: 2239)
AAT-528 Target: 5'-ATCGCTACAGCCTTTGCAATGCTCTCC-3'   (SEQ ID NO: 2379)

5'-UCGCUACAGCCUUUGCAAUGCUCUCCC-3'   (SEQ ID NO: 2800)
                3'-AGCGAUGUCGGAAACGUUACGAGAGGG-5'   (SEQ ID NO: 2240)
AAT-529 Target: 5'-TCGCTACAGCCTTTGCAATGCTCTCCC-3'   (SEQ ID NO: 2380)

5'-CGCUACAGCCUUUGCAAUGCUCUCCCU-3'   (SEQ ID NO: 2801)
                3'-GCGAUGUCGGAAACGUUACGAGAGGGA-5'   (SEQ ID NO: 2241)
AAT-530 Target: 5'-CGCTACAGCCTTTGCAATGCTCTCCCT-3'   (SEQ ID NO: 2381)

5'-GCUACAGCCUUUGCAAUGCUCUCCCUG-3'   (SEQ ID NO: 2802)
                3'-CGAUGUCGGAAACGUUACGAGAGGGAC-5'   (SEQ ID NO: 2242)
AAT-531 Target: 5'-GCTACAGCCTTTGCAATGCTCTCCCTG-3'   (SEQ ID NO: 2382)

5'-UCCCUGGGGACCAAGGCUGACACUCAC-3'   (SEQ ID NO: 2803)
                3'-AGGGACCCCUGGUUCCGACUGUGAGUG-5'   (SEQ ID NO: 2243)
AAT-552 Target: 5'-TCCCTGGGGACCAAGGCTGACACTCAC-3'   (SEQ ID NO: 2383)

5'-UGGGGACCAAGGCUGACACUCACGAUG-3'   (SEQ ID NO: 2804)
                3'-ACCCCUGGUUCCGACUGUGAGUGCUAC-5'   (SEQ ID NO: 2244)
AAT-556 Target: 5'-TGGGGACCAAGGCTGACACTCACGATG-3'   (SEQ ID NO: 2384)

5'-GGGGACCAAGGCUGACACUCACGAUGA-3'   (SEQ ID NO: 2805)
                3'-CCCCUGGUUCCGACUGUGAGUGCUACU-5'   (SEQ ID NO: 2245)
AAT-557 Target: 5'-GGGGACCAAGGCTGACACTCACGATGA-3'   (SEQ ID NO: 2385)
```

TABLE 15-continued

Further Human Anti-α-1 antitrypsin "Blunt/Blunt" DsiRNAs

```
                  5'-GGGACCAAGGCUGACACUCACGAUGAA-3'    (SEQ ID NO: 2806)
                  3'-CCCUGGUUCCGACUGUGAGUGCUACUU-5'    (SEQ ID NO: 2246)
AAT-558 Target:   5'-GGGACCAAGGCTGACACTCACGATGAA-3'    (SEQ ID NO: 2386)

5'-GAUGAAAUCCUGGAGGGCCUGAAUUUC-3'    (SEQ ID NO: 2807)
                  3'-CUACUUUAGGACCUCCCGGACUUAAAG-5'    (SEQ ID NO: 2247)
AAT-579 Target:   5'-GATGAAATCCTGGAGGGCCTGAATTTC-3'    (SEQ ID NO: 2387)

5'-AUGAAAUCCUGGAGGGCCUGAAUUUCA-3'    (SEQ ID NO: 2808)
                  3'-UACUUUAGGACCUCCCGGACUUAAAGU-5'    (SEQ ID NO: 2248)
AAT-580 Target:   5'-ATGAAATCCTGGAGGGCCTGAATTTCA-3'    (SEQ ID NO: 2388)

5'-GAUCCAUGAAGGCUUCCAGGAACUCCU-3'    (SEQ ID NO: 2809)
                  3'-CUAGGUACUUCCGAAGGUCCUUGAGGA-5'    (SEQ ID NO: 2249)
AAT-632 Target:   5'-GATCCATGAAGGCTTCCAGGAACTCCT-3'    (SEQ ID NO: 2389)

5'-AUCCAUGAAGGCUUCCAGGAACUCCUC-3'    (SEQ ID NO: 2810)
                  3'-UAGGUACUUCCGAAGGUCCUUGAGGAG-5'    (SEQ ID NO: 2250)
AAT-633 Target:   5'-ATCCATGAAGGCTTCCAGGAACTCCTC-3'    (SEQ ID NO: 2390)

5'-GGGGACACCGAAGAGGCCAAGAAACAG-3'    (SEQ ID NO: 2811)
                  3'-CCCCUGUGGCUUCUCCGGUUCUUUGUC-5'    (SEQ ID NO: 2251)
AAT-801 Target:   5'-GGGGACACCGAAGAGGCCAAGAAACAG-3'    (SEQ ID NO: 2391)

5'-GGGACACCGAAGAGGCCAAGAAACAGA-3'    (SEQ ID NO: 2812)
                  3'-CCCUGUGGCUUCUCCGGUUCUUUGUCU-5'    (SEQ ID NO: 2252)
AAT-802 Target:   5'-GGGACACCGAAGAGGCCAAGAAACAGA-3'    (SEQ ID NO: 2392)

5'-GGACACCGAAGAGGCCAAGAAACAGAU-3'    (SEQ ID NO: 2813)
                  3'-CCUGUGGCUUCUCCGGUUCUUUGUCUA-5'    (SEQ ID NO: 2253)
AAT-803 Target:   5'-GGACACCGAAGAGGCCAAGAAACAGAT-3'    (SEQ ID NO: 2393)

5'-GACACCGAAGAGGCCAAGAAACAGAUC-3'    (SEQ ID NO: 2814)
                  3'-CUGUGGCUUCUCCGGUUCUUUGUCUAG-5'    (SEQ ID NO: 2254)
AAT-804 Target:   5'-GACACCGAAGAGGCCAAGAAACAGATC-3'    (SEQ ID NO: 2394)

5'-ACACCGAAGAGGCCAAGAAACAGAUCA-3'    (SEQ ID NO: 2815)
                  3'-UGUGGCUUCUCCGGUUCUUUGUCUAGU-5'    (SEQ ID NO: 2255)
AAT-805 Target:   5'-ACACCGAAGAGGCCAAGAAACAGATCA-3'    (SEQ ID NO: 2395)

5'-CACCGAAGAGGCCAAGAAACAGAUCAA-3'    (SEQ ID NO: 2816)
                  3'-GUGGCUUCUCCGGUUCUUUGUCUAGUU-5'    (SEQ ID NO: 2256)
AAT-806 Target:   5'-CACCGAAGAGGCCAAGAAACAGATCAA-3'    (SEQ ID NO: 2396)

5'-ACCGAAGAGGCCAAGAAACAGAUCAAC-3'    (SEQ ID NO: 2817)
                  3'-UGGCUUCUCCGGUUCUUUGUCUAGUUG-5'    (SEQ ID NO: 2257)
AAT-807 Target:   5'-ACCGAAGAGGCCAAGAAACAGATCAAC-3'    (SEQ ID NO: 2397)

5'-CCGAAGAGGCCAAGAAACAGAUCAACG-3'    (SEQ ID NO: 2818)
                  3'-GGCUUCUCCGGUUCUUUGUCUAGUUGC-5'    (SEQ ID NO: 2258)
AAT-808 Target:   5'-CCGAAGAGGCCAAGAAACAGATCAACG-3'    (SEQ ID NO: 2398)

5'-CGAAGAGGCCAAGAAACAGAUCAACGA-3'    (SEQ ID NO: 2819)
                  3'-GCUUCUCCGGUUCUUUGUCUAGUUGCU-5'    (SEQ ID NO: 2259)
AAT-809 Target:   5'-CGAAGAGGCCAAGAAACAGATCAACGA-3'    (SEQ ID NO: 2399)

5'-GAAGAGGCCAAGAAACAGAUCAACGAU-3'    (SEQ ID NO: 2820)
                  3'-CUUCUCCGGUUCUUUGUCUAGUUGCUA-5'    (SEQ ID NO: 2260)
AAT-810 Target:   5'-GAAGAGGCCAAGAAACAGATCAACGAT-3'    (SEQ ID NO: 2400)

5'-AAGAGGCCAAGAAACAGAUCAACGAUU-3'    (SEQ ID NO: 2821)
                  3'-UUCUCCGGUUCUUUGUCUAGUUGCUAA-5'    (SEQ ID NO: 2261)
AAT-811 Target:   5'-AAGAGGCCAAGAAACAGATCAACGATT-3'    (SEQ ID NO: 2401)

5'-AGAGGCCAAGAAACAGAUCAACGAUUA-3'    (SEQ ID NO: 2822)
                  3'-UCUCCGGUUCUUUGUCUAGUUGCUAAU-5'    (SEQ ID NO: 2262)
AAT-812 Target:   5'-AGAGGCCAAGAAACAGATCAACGATTA-3'    (SEQ ID NO: 2402)

5'-GAGGCCAAGAAACAGAUCAACGAUUAC-3'    (SEQ ID NO: 2823)
                  3'-CUCCGGUUCUUUGUCUAGUUGCUAAUG-5'    (SEQ ID NO: 2263)
AAT-813 Target:   5'-GAGGCCAAGAAACAGATCAACGATTAC-3'    (SEQ ID NO: 2403)

5'-GUUUUUGCUCUGGUGAAUUACAUCUUC-3'    (SEQ ID NO: 2824)
                  3'-CAAAAACGAGACCACUUAAUGUAGAAG-5'    (SEQ ID NO: 2264)
AAT-900 Target:   5'-GTTTTTGCTCTGGTGAATTACATCTTC-3'    (SEQ ID NO: 2404)
```

TABLE 15-continued

Further Human Anti-α-1 antitrypsin "Blunt/Blunt" DsiRNAs

|  |  |  |
|---|---|---|
| | 5'-UUUUUGCUCGGUGAAUUACAUCUUCU-3' | (SEQ ID NO: 2825) |
| | 3'-AAAAACGAGACCACUUAAUGUAGAAGA-5' | (SEQ ID NO: 2265) |
| AAT-901 Target: | 5'-TTTTTGCTCTGGTGAATTACATCTTCT-3' | (SEQ ID NO: 2405) |
| | 5'-UUUUGCUCUGGUGAAUUACAUCUUCUU-3' | (SEQ ID NO: 2826) |
| | 3'-AAAACGAGACCACUUAAUGUAGAAGAA-5' | (SEQ ID NO: 2266) |
| AAT-902 Target: | 5'-TTTTGCTCTGGTGAATTACATCTTCTT-3' | (SEQ ID NO: 2406) |
| | 5'-UUUGCUCUGGUGAAUUACAUCUUCUUU-3' | (SEQ ID NO: 2827) |
| | 3'-AAACGAGACCACUUAAUGUAGAAGAAA-5' | (SEQ ID NO: 2267) |
| AAT-903 Target: | 5'-TTTGCTCTGGTGAATTACATCTTCTTT-3' | (SEQ ID NO: 2407) |
| | 5'-UUGCUCUGGUGAAUUACAUCUUCUUUA-3' | (SEQ ID NO: 2828) |
| | 3'-AACGAGACCACUUAAUGUAGAAGAAAU-5' | (SEQ ID NO: 2268) |
| AAT-904 Target: | 5'-TTGCTCTGGTGAATTACATCTTCTTTA-3' | (SEQ ID NO: 2408) |
| | 5'-UGCUCUGGUGAAUUACAUCUUCUUUAA-3' | (SEQ ID NO: 2829) |
| | 3'-ACGAGACCACUUAAUGUAGAAGAAAUU-5' | (SEQ ID NO: 2269) |
| AAT-905 Target: | 5'-TGCTCTGGTGAATTACATCTTCTTTAA-3' | (SEQ ID NO: 2409) |
| | 5'-GCUCUGGUGAAUUACAUCUUCUUUAAA-3' | (SEQ ID NO: 2830) |
| | 3'-CGAGACCACUUAAUGUAGAAGAAAUUU-5' | (SEQ ID NO: 2270) |
| AAT-906 Target: | 5'-GCTCTGGTGAATTACATCTTCTTTAAA-3' | (SEQ ID NO: 2410) |
| | 5'-CUCUGGUGAAUUACAUCUUCUUUAAAG-3' | (SEQ ID NO: 2831) |
| | 3'-GAGACCACUUAAUGUAGAAGAAAUUUC-5' | (SEQ ID NO: 2271) |
| AAT-907 Target: | 5'-CTCTGGTGAATTACATCTTCTTTAAAG-3' | (SEQ ID NO: 2411) |
| | 5'-UCUGGUGAAUUACAUCUUCUUUAAAGG-3' | (SEQ ID NO: 2832) |
| | 3'-AGACCACUUAAUGUAGAAGAAAUUUCC-5' | (SEQ ID NO: 2272) |
| AAT-908 Target: | 5'-TCTGGTGAATTACATCTTCTTTAAAGG-3' | (SEQ ID NO: 2412) |
| | 5'-CUGGUGAAUUACAUCUUCUUUAAAGGC-3' | (SEQ ID NO: 2833) |
| | 3'-GACCACUUAAUGUAGAAGAAAUUUCCG-5' | (SEQ ID NO: 2273) |
| AAT-909 Target: | 5'-CTGGTGAATTACATCTTCTTTAAAGGC-3' | (SEQ ID NO: 2413) |
| | 5'-UGGUGAAUUACAUCUUCUUUAAAGGCA-3' | (SEQ ID NO: 2834) |
| | 3'-ACCACUUAAUGUAGAAGAAAUUUCCGU-5' | (SEQ ID NO: 2274) |
| AAT-910 Target: | 5'-TGGTGAATTACATCTTCTTTAAAGGCA-3' | (SEQ ID NO: 2414) |
| | 5'-GGUGAAUUACAUCUUCUUUAAAGGCAA-3' | (SEQ ID NO: 2835) |
| | 3'-CCACUUAAUGUAGAAGAAAUUUCCGUU-5' | (SEQ ID NO: 2275) |
| AAT-911 Target: | 5'-GGTGAATTACATCTTCTTTAAAGGCAA-3' | (SEQ ID NO: 2415) |
| | 5'-GUGAAUUACAUCUUCUUUAAAGGCAAA-3' | (SEQ ID NO: 2836) |
| | 3'-CACUUAAUGUAGAAGAAAUUUCCGUUU-5' | (SEQ ID NO: 2276) |
| AAT-912 Target: | 5'-GTGAATTACATCTTCTTTAAAGGCAAA-3' | (SEQ ID NO: 2416) |
| | 5'-UGAAUUACAUCUUCUUUAAAGGCAAAU-3' | (SEQ ID NO: 2837) |
| | 3'-ACUUAAUGUAGAAGAAAUUUCCGUUUA-5' | (SEQ ID NO: 2277) |
| AAT-913 Target: | 5'-TGAATTACATCTTCTTTAAAGGCAAAT-3' | (SEQ ID NO: 2417) |
| | 5'-GAAUUACAUCUUCUUUAAAGGCAAAUG-3' | (SEQ ID NO: 2838) |
| | 3'-CUUAAUGUAGAAGAAAUUUCCGUUUAC-5' | (SEQ ID NO: 2278) |
| AAT-914 Target: | 5'-GAATTACATCTTCTTTAAAGGCAAATG-3' | (SEQ ID NO: 2418) |
| | 5'-AAUUACAUCUUCUUUAAAGGCAAAUGG-3' | (SEQ ID NO: 2839) |
| | 3'-UUAAUGUAGAAGAAAUUUCCGUUUACC-5' | (SEQ ID NO: 2279) |
| AAT-915 Target: | 5'-AATTACATCTTCTTTAAAGGCAAATGG-3' | (SEQ ID NO: 2419) |
| | 5'-AUUACAUCUUCUUUAAAGGCAAAUGGG-3' | (SEQ ID NO: 2840) |
| | 3'-UAAUGUAGAAGAAAUUUCCGUUUACCC-5' | (SEQ ID NO: 2280) |
| AAT-916 Target: | 5'-ATTACATCTTCTTTAAAGGCAAATGGG-3' | (SEQ ID NO: 2420) |
| | 5'-UUACAUCUUCUUUAAAGGCAAAUGGGA-3' | (SEQ ID NO: 2841) |
| | 3'-AAUGUAGAAGAAAUUUCCGUUUACCCU-5' | (SEQ ID NO: 2281) |
| AAT-917 Target: | 5'-TTACATCTTCTTTAAAGGCAAATGGGA-3' | (SEQ ID NO: 2421) |
| | 5'-UACAUCUUCUUUAAAGGCAAAUGGGAG-3' | (SEQ ID NO: 2842) |
| | 3'-AUGUAGAAGAAAUUUCCGUUUACCCUC-5' | (SEQ ID NO: 2282) |
| AAT-918 Target: | 5'-TACATCTTCTTTAAAGGCAAATGGGAG-3' | (SEQ ID NO: 2422) |
| | 5'-UCUUCUUUAAAGGCAAAUGGGAGAGAC-3' | (SEQ ID NO: 2843) |
| | 3'-AGAAGAAAUUUCCGUUUACCCUCUCUG-5' | (SEQ ID NO: 2283) |
| AAT-922 Target: | 5'-TCTTCTTTAAAGGCAAATGGGAGAGAC-3' | (SEQ ID NO: 2423) |

TABLE 15-continued

Further Human Anti-α-1 antitrypsin "Blunt/Blunt" DsiRNAs

```
                5'-UUCUUUAAAGGCAAAUGGGAGAGACCC-3'   (SEQ ID NO: 2844)
                3'-AAGAAAUUUCCGUUUACCCUCUCUGGG-5'   (SEQ ID NO: 2284)
AAT-924  Target: 5'-TTCTTTAAAGGCAAATGGGAGAGACCC-3'  (SEQ ID NO: 2424)

5'-AGGCAAAUGGGAGAGACCCUUUGAAGU-3'   (SEQ ID NO: 2845)
                3'-UCCGUUUACCCUCUCUGGGAAACUUCA-5'   (SEQ ID NO: 2285)
AAT-932  Target: 5'-AGGCAAATGGGAGAGACCCTTTGAAGT-3'  (SEQ ID NO: 2425)

5'-GGCAAAUGGGAGAGACCCUUUGAAGUC-3'   (SEQ ID NO: 2846)
                3'-CCGUUUACCCUCUCUGGGAAACUUCAG-5'   (SEQ ID NO: 2286)
AAT-933  Target: 5'-GGCAAATGGGAGAGACCCTTTGAAGTC-3'  (SEQ ID NO: 2426)

5'-GCAAAUGGGAGAGACCCUUUGAAGUCA-3'   (SEQ ID NO: 2847)
                3'-CGUUUACCCUCUCUGGGAAACUUCAGU-5'   (SEQ ID NO: 2287)
AAT-934  Target: 5'-GCAAATGGGAGAGACCCTTTGAAGTCA-3'  (SEQ ID NO: 2427)

5'-CAAAUGGGAGAGACCCUUUGAAGUCAA-3'   (SEQ ID NO: 2848)
                3'-GUUUACCCUCUCUGGGAAACUUCAGUU-5'   (SEQ ID NO: 2288)
AAT-935  Target: 5'-CAAATGGGAGAGACCCTTTGAAGTCAA-3'  (SEQ ID NO: 2428)

5'-GCUGUCCAGCUGGGUGCUGCUGAUGAA-3'   (SEQ ID NO: 2849)
                3'-CGACAGGUCGACCCACGACGACUACUU-5'   (SEQ ID NO: 2289)
AAT-1061 Target: 5'-GCTGTCCAGCTGGGTGCTGCTGATGAA-3'  (SEQ ID NO: 2429)

5'-CUGUCCAGCUGGGUGCUGCUGAUGAAA-3'   (SEQ ID NO: 2850)
                3'-GACAGGUCGACCCACGACGACUACUUU-5'   (SEQ ID NO: 2290)
AAT-1062 Target: 5'-CTGTCCAGCTGGGTGCTGCTGATGAAA-3'  (SEQ ID NO: 2430)

5'-UGUCCAGCUGGGUGCUGCUGAUGAAAU-3'   (SEQ ID NO: 2851)
                3'-ACAGGUCGACCCACGACGACUACUUUA-5'   (SEQ ID NO: 2291)
AAT-1063 Target: 5'-TGTCCAGCTGGGTGCTGCTGATGAAAT-3'  (SEQ ID NO: 2431)

5'-GUCCAGCUGGGUGCUGCUGAUGAAAUA-3'   (SEQ ID NO: 2852)
                3'-CAGGUCGACCCACGACGACUACUUUAU-5'   (SEQ ID NO: 2292)
AAT-1064 Target: 5'-GTCCAGCTGGGTGCTGCTGATGAAATA-3'  (SEQ ID NO: 2432)

5'-UCCAGCUGGGUGCUGCUGAUGAAAUAC-3'   (SEQ ID NO: 2853)
                3'-AGGUCGACCCACGACGACUACUUUAUG-5'   (SEQ ID NO: 2293)
AAT-1065 Target: 5'-TCCAGCTGGGTGCTGCTGATGAAATAC-3'  (SEQ ID NO: 2433)

5'-CCAGCUGGGUGCUGCUGAUGAAAUACC-3'   (SEQ ID NO: 2854)
                3'-GGUCGACCCACGACGACUACUUUAUGG-5'   (SEQ ID NO: 2294)
AAT-1066 Target: 5'-CCAGCTGGGTGCTGCTGATGAAATACC-3'  (SEQ ID NO: 2434)

5'-CAGCUGGGUGCUGCUGAUGAAAUACCU-3'   (SEQ ID NO: 2855)
                3'-GUCGACCCACGACGACUACUUUAUGGA-5'   (SEQ ID NO: 2295)
AAT-1067 Target: 5'-CAGCTGGGTGCTGCTGATGAAATACCT-3'  (SEQ ID NO: 2435)

5'-AGCUGGGUGCUGCUGAUGAAAUACCUG-3'   (SEQ ID NO: 2856)
                3'-UCGACCCACGACGACUACUUUAUGGAC-5'   (SEQ ID NO: 2296)
AAT-1068 Target: 5'-AGCTGGGTGCTGCTGATGAAATACCTG-3'  (SEQ ID NO: 2436)

5'-GCUGGGUGCUGCUGAUGAAAUACCUGG-3'   (SEQ ID NO: 2857)
                3'-CGACCCACGACGACUACUUUAUGGACC-5'   (SEQ ID NO: 2297)
AAT-1069 Target: 5'-GCTGGGTGCTGCTGATGAAATACCTGG-3'  (SEQ ID NO: 2437)

5'-CUGGGUGCUGCUGAUGAAAUACCUGGG-3'   (SEQ ID NO: 2858)
                3'-GACCCACGACGACUACUUUAUGGACCC-5'   (SEQ ID NO: 2298)
AAT-1070 Target: 5'-CTGGGTGCTGCTGATGAAATACCTGGG-3'  (SEQ ID NO: 2438)

5'-GGGUGCUGCUGAUGAAAUACCUGGGCA-3'   (SEQ ID NO: 2859)
                3'-CCCACGACGACUACUUUAUGGACCCGU-5'   (SEQ ID NO: 2299)
AAT-1072 Target: 5'-GGGTGCTGCTGATGAAATACCTGGGCA-3'  (SEQ ID NO: 2439)

5'-GGUGCUGCUGAUGAAAUACCUGGGCAA-3'   (SEQ ID NO: 2860)
                3'-CCACGACGACUACUUUAUGGACCCGUU-5'   (SEQ ID NO: 2300)
AAT-1073 Target: 5'-GGTGCTGCTGATGAAATACCTGGGCAA-3'  (SEQ ID NO: 2440)

5'-GUGCUGCUGAUGAAAUACCUGGGCAAU-3'   (SEQ ID NO: 2861)
                3'-CACGACGACUACUUUAUGGACCCGUUA-5'   (SEQ ID NO: 2301)
AAT-1074 Target: 5'-GTGCTGCTGATGAAATACCTGGGCAAT-3'  (SEQ ID NO: 2441)

5'-UGCUGCUGAUGAAAUACCUGGGCAAUG-3'   (SEQ ID NO: 2862)
                3'-ACGACGACUACUUUAUGGACCCGUUAC-5'   (SEQ ID NO: 2302)
AAT-1075 Target: 5'-TGCTGCTGATGAAATACCTGGGCAATG-3'  (SEQ ID NO: 2442)
```

TABLE 15-continued

Further Human Anti-α-1 antitrypsin "Blunt/Blunt" DsiRNAs

```
            5'-GCUGCUGAUGAAAUACCUGGGCAAUGC-3'  (SEQ ID NO: 2863)
            3'-CGACGACUACUUUAUGGACCCGUUACG-5'  (SEQ ID NO: 2303)
AAT-1076 Target: 5'-GCTGCTGATGAAATACCTGGGCAATGC-3'  (SEQ ID NO: 2443)

5'-CUGCUGAUGAAAUACCUGGGCAAUGCC-3'  (SEQ ID NO: 2864)
            3'-GACGACUACUUUAUGGACCCGUUACGG-5'  (SEQ ID NO: 2304)
AAT-1077 Target: 5'-CTGCTGATGAAATACCTGGGCAATGCC-3'  (SEQ ID NO: 2444)

5'-UGCUGAUGAAAUACCUGGGCAAUGCCA-3'  (SEQ ID NO: 2865)
            3'-ACGACUACUUUAUGGACCCGUUACGGU-5'  (SEQ ID NO: 2305)
AAT-1078 Target: 5'-TGCTGATGAAATACCTGGGCAATGCCA-3'  (SEQ ID NO: 2445)

5'-GCUGAUGAAAUACCUGGGCAAUGCCAC-3'  (SEQ ID NO: 2866)
            3'-CGACUACUUUAUGGACCCGUUACGGUG-5'  (SEQ ID NO: 2306)
AAT-1079 Target: 5'-GCTGATGAAATACCTGGGCAATGCCAC-3'  (SEQ ID NO: 2446)

5'-CUGAUGAAAUACCUGGGCAAUGCCACC-3'  (SEQ ID NO: 2867)
            3'-GACUACUUUAUGGACCCGUUACGGUGG-5'  (SEQ ID NO: 2307)
AAT-1080 Target: 5'-CTGATGAAATACCTGGGCAATGCCACC-3'  (SEQ ID NO: 2447)

5'-UGAUGAAAUACCUGGGCAAUGCCACCG-3'  (SEQ ID NO: 2868)
            3'-ACUACUUUAUGGACCCGUUACGGUGGC-5'  (SEQ ID NO: 2308)
AAT-1081 Target: 5'-TGATGAAATACCTGGGCAATGCCACCG-3'  (SEQ ID NO: 2448)

5'-AUGAAAUACCUGGGCAAUGCCACCGCC-3'  (SEQ ID NO: 2869)
            3'-UACUUUAUGGACCCGUUACGGUGGCGG-5'  (SEQ ID NO: 2309)
AAT-1083 Target: 5'-ATGAAATACCTGGGCAATGCCACCGCC-3'  (SEQ ID NO: 2449)

5'-UACAGCACCUGGAAAAUGAACUCACCC-3'  (SEQ ID NO: 2870)
            3'-AUGUCGUGGACCUUUUACUUGAGUGGG-5'  (SEQ ID NO: 2310)
AAT-1138 Target: 5'-TACAGCACCTGGAAAATGAACTCACCC-3'  (SEQ ID NO: 2450)

5'-ACCUGGAAAAUGAACUCACCCACGAUA-3'  (SEQ ID NO: 2871)
            3'-UGGACCUUUUACUUGAGUGGGUGCUAU-5'  (SEQ ID NO: 2311)
AAT-1144 Target: 5'-ACCTGGAAAATGAACTCACCCACGATA-3'  (SEQ ID NO: 2451)

5'-CCUGGAAAAUGAACUCACCCACGAUAU-3'  (SEQ ID NO: 2872)
            3'-GGACCUUUUACUUGAGUGGGUGCUAUA-5'  (SEQ ID NO: 2312)
AAT-1145 Target: 5'-CCTGGAAAATGAACTCACCCACGATAT-3'  (SEQ ID NO: 2452)

5'-ACGAUAUCAUCACCAAGUUCCUGGAAA-3'  (SEQ ID NO: 2873)
            3'-UGCUAUAGUAGUGGUUCAAGGACCUUU-5'  (SEQ ID NO: 2313)
AAT-1165 Target: 5'-ACGATATCATCACCAAGTTCCTGGAAA-3'  (SEQ ID NO: 2453)

5'-ACCAAGUUCCUGGAAAAUGAAGACAGA-3'  (SEQ ID NO: 2874)
            3'-UGGUUCAAGGACCUUUUACUUCUGUCU-5'  (SEQ ID NO: 2314)
AAT-1176 Target: 5'-ACCAAGTTCCTGGAAAATGAAGACAGA-3'  (SEQ ID NO: 2454)

5'-GUCCAUUACUGGAACCUAUGAUCUGAA-3'  (SEQ ID NO: 2875)
            3'-CAGGUAAUGACCUUGGAUACUAGACUU-5'  (SEQ ID NO: 2315)
AAT-1232 Target: 5'-GTCCATTACTGGAACCTATGATCTGAA-3'  (SEQ ID NO: 2455)

5'-UCCAUUACUGGAACCUAUGAUCUGAAG-3'  (SEQ ID NO: 2876)
            3'-AGGUAAUGACCUUGGAUACUAGACUUC-5'  (SEQ ID NO: 2316)
AAT-1233 Target: 5'-TCCATTACTGGAACCTATGATCTGAAG-3'  (SEQ ID NO: 2456)

5'-CCAUUACUGGAACCUAUGAUCUGAAGA-3'  (SEQ ID NO: 2877)
            3'-GGUAAUGACCUUGGAUACUAGACUUCU-5'  (SEQ ID NO: 2317)
AAT-1234 Target: 5'-CCATTACTGGAACCTATGATCTGAAGA-3'  (SEQ ID NO: 2457)

5'-CAUUACUGGAACCUAUGAUCUGAAGAG-3'  (SEQ ID NO: 2878)
            3'-GUAAUGACCUUGGAUACUAGACUUCUC-5'  (SEQ ID NO: 2318)
AAT-1235 Target: 5'-CATTACTGGAACCTATGATCTGAAGAG-3'  (SEQ ID NO: 2458)

5'-AUUACUGGAACCUAUGAUCUGAAGAGC-3'  (SEQ ID NO: 2879)
            3'-UAAUGACCUUGGAUACUAGACUUCUCG-5'  (SEQ ID NO: 2319)
AAT-1236 Target: 5'-ATTACTGGAACCTATGATCTGAAGAGC-3'  (SEQ ID NO: 2459)

5'-UUACUGGAACCUAUGAUCUGAAGAGCG-3'  (SEQ ID NO: 2880)
            3'-AAUGACCUUGGAUACUAGACUUCUCGC-5'  (SEQ ID NO: 2320)
AAT-1237 Target: 5'-TTACTGGAACCTATGATCTGAAGAGCG-3'  (SEQ ID NO: 2460)

5'-UACUGGAACCUAUGAUCUGAAGAGCGU-3'  (SEQ ID NO: 2881)
            3'-AUGACCUUGGAUACUAGACUUCUCGCA-5'  (SEQ ID NO: 2321)
AAT-1238 Target: 5'-TACTGGAACCTATGATCTGAAGAGCGT-3'  (SEQ ID NO: 2461)
```

TABLE 15-continued

Further Human Anti-α-1 antitrypsin "Blunt/Blunt" DsiRNAs

```
              5'-ACUGGAACCUAUGAUCUGAAGAGCGUC-3'    (SEQ ID NO: 2882)
              3'-UGACCUUGGAUACUAGACUUCUCGCAG-5'    (SEQ ID NO: 2322)
AAT-1239 Target: 5'-ACTGGAACCTATGATCTGAAGAGCGTC-3' (SEQ ID NO: 2462)

5'-CUGGAACCUAUGAUCUGAAGAGCGUCC-3'    (SEQ ID NO: 2883)
              3'-GACCUUGGAUACUAGACUUCUCGCAGG-5'    (SEQ ID NO: 2323)
AAT-1240 Target: 5'-CTGGAACCTATGATCTGAAGAGCGTCC-3' (SEQ ID NO: 2463)

5'-GCAUCACUAAGGUCUUCAGCAAUGGGG-3'    (SEQ ID NO: 2884)
              3'-CGUAGUGAUUCCAGAAGUCGUUACCCC-5'    (SEQ ID NO: 2324)
AAT-1279 Target: 5'-GCATCACTAAGGTCTTCAGCAATGGGG-3' (SEQ ID NO: 2464)

5'-CAUCACUAAGGUCUUCAGCAAUGGGGC-3'    (SEQ ID NO: 2885)
              3'-GUAGUGAUUCCAGAAGUCGUUACCCCG-5'    (SEQ ID NO: 2325)
AAT-1280 Target: 5'-CATCACTAAGGTCTTCAGCAATGGGGC-3' (SEQ ID NO: 2465)

5'-AUCACUAAGGUCUUCAGCAAUGGGGCU-3'    (SEQ ID NO: 2886)
              3'-UAGUGAUUCCAGAAGUCGUUACCCCGA-5'    (SEQ ID NO: 2326)
AAT-1281 Target: 5'-ATCACTAAGGTCTTCAGCAATGGGGCT-3' (SEQ ID NO: 2466)

5'-CACUAAGGUCUUCAGCAAUGGGGCUGA-3'    (SEQ ID NO: 2887)
              3'-GUGAUUCCAGAAGUCGUUACCCCGACU-5'    (SEQ ID NO: 2327)
AAT-1283 Target: 5'-CACTAAGGTCTTCAGCAATGGGGCTGA-3' (SEQ ID NO: 2467)

5'-ACUAAGGUCUUCAGCAAUGGGGCUGAC-3'    (SEQ ID NO: 2888)
              3'-UGAUUCCAGAAGUCGUUACCCCGACUG-5'    (SEQ ID NO: 2328)
AAT-1284 Target: 5'-ACTAAGGTCTTCAGCAATGGGGCTGAC-3' (SEQ ID NO: 2468)

5'-CCUGAAGCUCUCCAAGGCCGUGCAUAA-3'    (SEQ ID NO: 2889)
              3'-GGACUUCGAGAGGUUCCGGCACGUAUU-5'    (SEQ ID NO: 2329)
AAT-1337 Target: 5'-CCTGAAGCTCTCCAAGGCCGTGCATAA-3' (SEQ ID NO: 2469)

5'-CUGAAGCUCUCCAAGGCCGUGCAUAAG-3'    (SEQ ID NO: 2890)
              3'-GACUUCGAGAGGUUCCGGCACGUAUUC-5'    (SEQ ID NO: 2330)
AAT-1338 Target: 5'-CTGAAGCTCTCCAAGGCCGTGCATAAG-3' (SEQ ID NO: 2470)

5'-UGAAGCUCUCCAAGGCCGUGCAUAAGG-3'    (SEQ ID NO: 2891)
              3'-ACUUCGAGAGGUUCCGGCACGUAUUCC-5'    (SEQ ID NO: 2331)
AAT-1339 Target: 5'-TGAAGCTCTCCAAGGCCGTGCATAAGG-3' (SEQ ID NO: 2471)

5'-CCCCGAGGUCAAGUUCAACAAACCCUU-3'    (SEQ ID NO: 2892)
              3'-GGGGCUCCAGUUCAAGUUGUUUGGGAA-5'    (SEQ ID NO: 2332)
AAT-1442 Target: 5'-CCCCGAGGTCAAGTTCAACAAACCCTT-3' (SEQ ID NO: 2472)

5'-CCCGAGGUCAAGUUCAACAAACCCUUU-3'    (SEQ ID NO: 2893)
              3'-GGGCUCCAGUUCAAGUUGUUUGGGAAA-5'    (SEQ ID NO: 2333)
AAT-1443 Target: 5'-CCCGAGGTCAAGTTCAACAAACCCTTT-3' (SEQ ID NO: 2473)

5'-CCGAGGUCAAGUUCAACAAACCCUUUG-3'    (SEQ ID NO: 2894)
              3'-GGCUCCAGUUCAAGUUGUUUGGGAAAC-5'    (SEQ ID NO: 2334)
AAT-1444 Target: 5'-CCGAGGTCAAGTTCAACAAACCCTTTG-3' (SEQ ID NO: 2474)

5'-CGAGGUCAAGUUCAACAAACCCUUUGU-3'    (SEQ ID NO: 2895)
              3'-GCUCCAGUUCAAGUUGUUUGGGAAACA-5'    (SEQ ID NO: 2335)
AAT-1445 Target: 5'-CGAGGTCAAGTTCAACAAACCCTTTGT-3' (SEQ ID NO: 2475)

5'-GAGGUCAAGUUCAACAAACCCUUUGUC-3'    (SEQ ID NO: 2896)
              3'-CUCCAGUUCAAGUUGUUUGGGAAACAG-5'    (SEQ ID NO: 2336)
AAT-1446 Target: 5'-GAGGTCAAGTTCAACAAACCCTTTGTC-3' (SEQ ID NO: 2476)

5'-AGGUCAAGUUCAACAAACCCUUUGUCU-3'    (SEQ ID NO: 2897)
              3'-UCCAGUUCAAGUUGUUUGGGAAACAGA-5'    (SEQ ID NO: 2337)
AAT-1447 Target: 5'-AGGTCAAGTTCAACAAACCCTTTGTCT-3' (SEQ ID NO: 2477)

5'-GGUCAAGUUCAACAAACCCUUUGUCUU-3'    (SEQ ID NO: 2898)
              3'-CCAGUUCAAGUUGUUUGGGAAACAGAA-5'    (SEQ ID NO: 2338)
AAT-1448 Target: 5'-GGTCAAGTTCAACAAACCCTTTGTCTT-3' (SEQ ID NO: 2478)

5'-GUCAAGUUCAACAAACCCUUUGUCUUC-3'    (SEQ ID NO: 2899)
              3'-CAGUUCAAGUUGUUUGGGAAACAGAAG-5'    (SEQ ID NO: 2339)
AAT-1449 Target: 5'-GTCAAGTTCAACAAACCCTTTGTCTTC-3' (SEQ ID NO: 2479)

5'-UCAAGUUCAACAAACCCUUUGUCUUCU-3'    (SEQ ID NO: 2900)
              3'-AGUUCAAGUUGUUUGGGAAACAGAAGA-5'    (SEQ ID NO: 2340)
AAT-1450 Target: 5'-TCAAGTTCAACAAACCCTTTGTCTTCT-3' (SEQ ID NO: 2480)
```

TABLE 15-continued

Further Human Anti-α-1 antitrypsin "Blunt/Blunt" DsiRNAs

```
                5'-CAAGUUCAACAAACCCUUUGUCUUCUU-3'  (SEQ ID NO: 2901)
                3'-GUUCAAGUUGUUUGGGAAACAGAAGAA-5'  (SEQ ID NO: 2341)
AAT-1451 Target: 5'-CAAGTTCAACAAACCCTTTGTCTTCTT-3'  (SEQ ID NO: 2481)
```

TABLE 16

Further DsiRNA Component 19 Nucleotide Target Sequences in α-1 antitrypsin mRNA

| | | |
|---|---|---|
| AAT-366 19 nt Target #1: | 5'-CCAGGGAGAUGCUGCCCAG-3' | (SEQ ID NO: 2902) |
| AAT-366 19 nt Target #2: | 5'-CCCAGGGAGAUGCUGCCCA-3' | (SEQ ID NO: 3042) |
| AAT-366 19 nt Target #3: | 5'-CCCCAGGGAGAUGCUGCCC-3' | (SEQ ID NO: 3182) |
| AAT-367 19 nt Target #1: | 5'-CAGGGAGAUGCUGCCCAGA-3' | (SEQ ID NO: 2903) |
| AAT-367 19 nt Target #2: | 5'-CCAGGGAGAUGCUGCCCAG-3' | (SEQ ID NO: 3043) |
| AAT-367 19 nt Target #3: | 5'-CCCAGGGAGAUGCUGCCCA-3' | (SEQ ID NO: 3183) |
| AAT-368 19 nt Target #1: | 5'-AGGGAGAUGCUGCCCAGAA-3' | (SEQ ID NO: 2904) |
| AAT-368 19 nt Target #2: | 5'-CAGGGAGAUGCUGCCCAGA-3' | (SEQ ID NO: 3044) |
| AAT-368 19 nt Target #3: | 5'-CCAGGGAGAUGCUGCCCAG-3' | (SEQ ID NO: 3184) |
| AAT-369 19 nt Target #1: | 5'-GGGAGAUGCUGCCCAGAAG-3' | (SEQ ID NO: 2905) |
| AAT-369 19 nt Target #2: | 5'-AGGGAGAUGCUGCCCAGAA-3' | (SEQ ID NO: 3045) |
| AAT-369 19 nt Target #3: | 5'-CAGGGAGAUGCUGCCCAGA-3' | (SEQ ID NO: 3185) |
| AAT-370 19 nt Target #1: | 5'-GGAGAUGCUGCCCAGAAGA-3' | (SEQ ID NO: 2906) |
| AAT-370 19 nt Target #2: | 5'-GGGAGAUGCUGCCCAGAAG-3' | (SEQ ID NO: 3046) |
| AAT-370 19 nt Target #3: | 5'-AGGGAGAUGCUGCCCAGAA-3' | (SEQ ID NO: 3186) |
| AAT-371 19 nt Target #1: | 5'-GAGAUGCUGCCCAGAAGAC-3' | (SEQ ID NO: 2907) |
| AAT-371 19 nt Target #2: | 5'-GGAGAUGCUGCCCAGAAGA-3' | (SEQ ID NO: 3047) |
| AAT-371 19 nt Target #3: | 5'-GGGAGAUGCUGCCCAGAAG-3' | (SEQ ID NO: 3187) |
| AAT-391 19 nt Target #1: | 5'-GAUACAUCCCACCAUGAUC-3' | (SEQ ID NO: 2908) |
| AAT-391 19 nt Target #2: | 5'-AGAUACAUCCCACCAUGAU-3' | (SEQ ID NO: 3048) |
| AAT-391 19 nt Target #3: | 5'-CAGAUACAUCCCACCAUGA-3' | (SEQ ID NO: 3188) |
| AAT-392 19 nt Target #1: | 5'-AUACAUCCCACCAUGAUCA-3' | (SEQ ID NO: 2909) |
| AAT-392 19 nt Target #2: | 5'-GAUACAUCCCACCAUGAUC-3' | (SEQ ID NO: 3049) |
| AAT-392 19 nt Target #3: | 5'-AGAUACAUCCCACCAUGAU-3' | (SEQ ID NO: 3189) |
| AAT-393 19 nt Target #1: | 5'-UACAUCCCACCAUGAUCAG-3' | (SEQ ID NO: 2910) |
| AAT-393 19 nt Target #2: | 5'-AUACAUCCCACCAUGAUCA-3' | (SEQ ID NO: 3050) |
| AAT-393 19 nt Target #3: | 5'-GAUACAUCCCACCAUGAUC-3' | (SEQ ID NO: 3190) |
| AAT-394 19 nt Target #1: | 5'-ACAUCCCACCAUGAUCAGG-3' | (SEQ ID NO: 2911) |
| AAT-394 19 nt Target #2: | 5'-UACAUCCCACCAUGAUCAG-3' | (SEQ ID NO: 3051) |
| AAT-394 19 nt Target #3: | 5'-AUACAUCCCACCAUGAUCA-3' | (SEQ ID NO: 3191) |
| AAT-485 19 nt Target #1: | 5'-ACCAGUCCAACAGCACCAA-3' | (SEQ ID NO: 2912) |
| AAT-485 19 nt Target #2: | 5'-CACCAGUCCAACAGCACCA-3' | (SEQ ID NO: 3052) |
| AAT-485 19 nt Target #3: | 5'-ACACCAGUCCAACAGCACC-3' | (SEQ ID NO: 3192) |

TABLE 16-continued

Further DsiRNA Component 19 Nucleotide Target
Sequences in α-1 antitrypsin mRNA

```
AAT-486 19 nt Target #1:   5'-CCAGUCCAACAGCACCAAU-3'   (SEQ ID NO: 2913)

AAT-486 19 nt Target #2:   5'-ACCAGUCCAACAGCACCAA-3'   (SEQ ID NO: 3053)

AAT-486 19 nt Target #3:   5'-CACCAGUCCAACAGCACCA-3'   (SEQ ID NO: 3193)

AAT-487 19 nt Target #1:   5'-CAGUCCAACAGCACCAAUA-3'   (SEQ ID NO: 2914)

AAT-487 19 nt Target #2:   5'-CCAGUCCAACAGCACCAAU-3'   (SEQ ID NO: 3054)

AAT-487 19 nt Target #3:   5'-ACCAGUCCAACAGCACCAA-3'   (SEQ ID NO: 3194)

AAT-488 19 nt Target #1:   5'-AGUCCAACAGCACCAAUAU-3'   (SEQ ID NO: 2915)

AAT-488 19 nt Target #2:   5'-CAGUCCAACAGCACCAAUA-3'   (SEQ ID NO: 3055)

AAT-488 19 nt Target #3:   5'-CCAGUCCAACAGCACCAAU-3'   (SEQ ID NO: 3195)

AAT-489 19 nt Target #1:   5'-GUCCAACAGCACCAAUAUC-3'   (SEQ ID NO: 2916)

AAT-489 19 nt Target #2:   5'-AGUCCAACAGCACCAAUAU-3'   (SEQ ID NO: 3056)

AAT-489 19 nt Target #3:   5'-CAGUCCAACAGCACCAAUA-3'   (SEQ ID NO: 3196)

AAT-490 19 nt Target #1:   5'-UCCAACAGCACCAAUAUCU-3'   (SEQ ID NO: 2917)

AAT-490 19 nt Target #2:   5'-GUCCAACAGCACCAAUAUC-3'   (SEQ ID NO: 3057)

AAT-490 19 nt Target #3:   5'-AGUCCAACAGCACCAAUAU-3'   (SEQ ID NO: 3197)

AAT-491 19 nt Target #1:   5'-CCAACAGCACCAAUAUCUU-3'   (SEQ ID NO: 2918)

AAT-491 19 nt Target #2:   5'-UCCAACAGCACCAAUAUCU-3'   (SEQ ID NO: 3058)

AAT-491 19 nt Target #3:   5'-GUCCAACAGCACCAAUAUC-3'   (SEQ ID NO: 3198)

AAT-492 19 nt Target #1:   5'-CAACAGCACCAAUAUCUUC-3'   (SEQ ID NO: 2919)

AAT-492 19 nt Target #2:   5'-CCAACAGCACCAAUAUCUU-3'   (SEQ ID NO: 3059)

AAT-492 19 nt Target #3:   5'-UCCAACAGCACCAAUAUCU-3'   (SEQ ID NO: 3199)

AAT-493 19 nt Target #1:   5'-AACAGCACCAAUAUCUUCU-3'   (SEQ ID NO: 2920)

AAT-493 19 nt Target #2:   5'-CAACAGCACCAAUAUCUUC-3'   (SEQ ID NO: 3060)

AAT-493 19 nt Target #3:   5'-CCAACAGCACCAAUAUCUU-3'   (SEQ ID NO: 3200)

AAT-494 19 nt Target #1:   5'-ACAGCACCAAUAUCUUCUU-3'   (SEQ ID NO: 2921)

AAT-494 19 nt Target #2:   5'-AACAGCACCAAUAUCUUCU-3'   (SEQ ID NO: 3061)

AAT-494 19 nt Target #3:   5'-CAACAGCACCAAUAUCUUC-3'   (SEQ ID NO: 3201)

AAT-495 19 nt Target #1:   5'-CAGCACCAAUAUCUUCUUC-3'   (SEQ ID NO: 2922)

AAT-495 19 nt Target #2:   5'-ACAGCACCAAUAUCUUCUU-3'   (SEQ ID NO: 3062)

AAT-495 19 nt Target #3:   5'-AACAGCACCAAUAUCUUCU-3'   (SEQ ID NO: 3202)

AAT-496 19 nt Target #1:   5'-AGCACCAAUAUCUUCUUCU-3'   (SEQ ID NO: 2923)

AAT-496 19 nt Target #2:   5'-CAGCACCAAUAUCUUCUUC-3'   (SEQ ID NO: 3063)

AAT-496 19 nt Target #3:   5'-ACAGCACCAAUAUCUUCUU-3'   (SEQ ID NO: 3203)

AAT-497 19 nt Target #1:   5'-GCACCAAUAUCUUCUUCUC-3'   (SEQ ID NO: 2924)

AAT-497 19 nt Target #2:   5'-AGCACCAAUAUCUUCUUCU-3'   (SEQ ID NO: 3064)

AAT-497 19 nt Target #3:   5'-CAGCACCAAUAUCUUCUUC-3'   (SEQ ID NO: 3204)

AAT-498 19 nt Target #1:   5'-CACCAAUAUCUUCUUCUCC-3'   (SEQ ID NO: 2925)

AAT-498 19 nt Target #2:   5'-GCACCAAUAUCUUCUUCUC-3'   (SEQ ID NO: 3065)
```

TABLE 16-continued

Further DsiRNA Component 19 Nucleotide Target
Sequences in α-1 antitrypsin mRNA

| | | | |
|---|---|---|---|
| AAT-498 19 nt Target #3: | 5'-AGCACCAAUAUCUUCUUCU-3' | (SEQ ID NO: 3205) |
| AAT-499 19 nt Target #1: | 5'-ACCAAUAUCUUCUUCUCCC-3' | (SEQ ID NO: 2926) |
| AAT-499 19 nt Target #2: | 5'-CACCAAUAUCUUCUUCUCC-3' | (SEQ ID NO: 3066) |
| AAT-499 19 nt Target #3: | 5'-GCACCAAUAUCUUCUUCUC-3' | (SEQ ID NO: 3206) |
| AAT-516 19 nt Target #1: | 5'-CCCAGUGAGCAUCGCUACA-3' | (SEQ ID NO: 2927) |
| AAT-516 19 nt Target #2: | 5'-CCCCAGUGAGCAUCGCUAC-3' | (SEQ ID NO: 3067) |
| AAT-516 19 nt Target #3: | 5'-UCCCCAGUGAGCAUCGCUA-3' | (SEQ ID NO: 3207) |
| AAT-517 19 nt Target #1: | 5'-CCAGUGAGCAUCGCUACAG-3' | (SEQ ID NO: 2928) |
| AAT-517 19 nt Target #2: | 5'-CCCAGUGAGCAUCGCUACA-3' | (SEQ ID NO: 3068) |
| AAT-517 19 nt Target #3: | 5'-CCCCAGUGAGCAUCGCUAC-3' | (SEQ ID NO: 3208) |
| AAT-518 19 nt Target #1: | 5'-CAGUGAGCAUCGCUACAGC-3' | (SEQ ID NO: 2929) |
| AAT-518 19 nt Target #2: | 5'-CCAGUGAGCAUCGCUACAG-3' | (SEQ ID NO: 3069) |
| AAT-518 19 nt Target #3: | 5'-CCCAGUGAGCAUCGCUACA-3' | (SEQ ID NO: 3209) |
| AAT-519 19 nt Target #1: | 5'-AGUGAGCAUCGCUACAGCC-3' | (SEQ ID NO: 2930) |
| AAT-519 19 nt Target #2: | 5'-CAGUGAGCAUCGCUACAGC-3' | (SEQ ID NO: 3070) |
| AAT-519 19 nt Target #3: | 5'-CCAGUGAGCAUCGCUACAG-3' | (SEQ ID NO: 3210) |
| AAT-520 19 nt Target #1: | 5'-GUGAGCAUCGCUACAGCCU-3' | (SEQ ID NO: 2931) |
| AAT-520 19 nt Target #2: | 5'-AGUGAGCAUCGCUACAGCC-3' | (SEQ ID NO: 3071) |
| AAT-520 19 nt Target #3: | 5'-CAGUGAGCAUCGCUACAGC-3' | (SEQ ID NO: 3211) |
| AAT-521 19 nt Target #1: | 5'-UGAGCAUCGCUACAGCCUU-3' | (SEQ ID NO: 2932) |
| AAT-521 19 nt Target #2: | 5'-GUGAGCAUCGCUACAGCCU-3' | (SEQ ID NO: 3072) |
| AAT-521 19 nt Target #3: | 5'-AGUGAGCAUCGCUACAGCC-3' | (SEQ ID NO: 3212) |
| AAT-522 19 nt Target #1: | 5'-GAGCAUCGCUACAGCCUUU-3' | (SEQ ID NO: 2933) |
| AAT-522 19 nt Target #2: | 5'-UGAGCAUCGCUACAGCCUU-3' | (SEQ ID NO: 3073) |
| AAT-522 19 nt Target #3: | 5'-GUGAGCAUCGCUACAGCCU-3' | (SEQ ID NO: 3213) |
| AAT-523 19 nt Target #1: | 5'-AGCAUCGCUACAGCCUUUG-3' | (SEQ ID NO: 2934) |
| AAT-523 19 nt Target #2: | 5'-GAGCAUCGCUACAGCCUUU-3' | (SEQ ID NO: 3074) |
| AAT-523 19 nt Target #3: | 5'-UGAGCAUCGCUACAGCCUU-3' | (SEQ ID NO: 3214) |
| AAT-524 19 nt Target #1: | 5'-GCAUCGCUACAGCCUUUGC-3' | (SEQ ID NO: 2935) |
| AAT-524 19 nt Target #2: | 5'-AGCAUCGCUACAGCCUUUG-3' | (SEQ ID NO: 3075) |
| AAT-524 19 nt Target #3: | 5'-GAGCAUCGCUACAGCCUUU-3' | (SEQ ID NO: 3215) |
| AAT-525 19 nt Target #1: | 5'-CAUCGCUACAGCCUUUGCA-3' | (SEQ ID NO: 2936) |
| AAT-525 19 nt Target #2: | 5'-GCAUCGCUACAGCCUUUGC-3' | (SEQ ID NO: 3076) |
| AAT-525 19 nt Target #3: | 5'-AGCAUCGCUACAGCCUUUG-3' | (SEQ ID NO: 3216) |
| AAT-526 19 nt Target #1: | 5'-AUCGCUACAGCCUUUGCAA-3' | (SEQ ID NO: 2937) |
| AAT-526 19 nt Target #2: | 5'-CAUCGCUACAGCCUUUGCA-3' | (SEQ ID NO: 3077) |
| AAT-526 19 nt Target #3: | 5'-GCAUCGCUACAGCCUUUGC-3' | (SEQ ID NO: 3217) |
| AAT-527 19 nt Target #1: | 5'-UCGCUACAGCCUUUGCAAU-3' | (SEQ ID NO: 2938) |
| AAT-527 19 nt Target #2: | 5'-AUCGCUACAGCCUUUGCAA-3' | (SEQ ID NO: 3078) |

TABLE 16-continued

Further DsiRNA Component 19 Nucleotide Target
Sequences in α-1 antitrypsin mRNA

```
AAT-527 19 nt Target #3:   5'-CAUCGCUACAGCCUUUGCA-3'   (SEQ ID NO: 3218)
AAT-528 19 nt Target #1:   5'-CGCUACAGCCUUUGCAAUG-3'   (SEQ ID NO: 2939)
AAT-528 19 nt Target #2:   5'-UCGCUACAGCCUUUGCAAU-3'   (SEQ ID NO: 3079)
AAT-528 19 nt Target #3:   5'-AUCGCUACAGCCUUUGCAA-3'   (SEQ ID NO: 3219)
AAT-529 19 nt Target #1:   5'-GCUACAGCCUUUGCAAUGC-3'   (SEQ ID NO: 2940)
AAT-529 19 nt Target #2:   5'-CGCUACAGCCUUUGCAAUG-3'   (SEQ ID NO: 3080)
AAT-529 19 nt Target #3:   5'-UCGCUACAGCCUUUGCAAU-3'   (SEQ ID NO: 3220)
AAT-530 19 nt Target #1:   5'-CUACAGCCUUUGCAAUGCU-3'   (SEQ ID NO: 2941)
AAT-530 19 nt Target #2:   5'-GCUACAGCCUUUGCAAUGC-3'   (SEQ ID NO: 3081)
AAT-530 19 nt Target #3:   5'-CGCUACAGCCUUUGCAAUG-3'   (SEQ ID NO: 3221)
AAT-531 19 nt Target #1:   5'-UACAGCCUUUGCAAUGCUC-3'   (SEQ ID NO: 2942)
AAT-531 19 nt Target #2:   5'-CUACAGCCUUUGCAAUGCU-3'   (SEQ ID NO: 3082)
AAT-531 19 nt Target #3:   5'-GCUACAGCCUUUGCAAUGC-3'   (SEQ ID NO: 3222)
AAT-552 19 nt Target #1:   5'-CCUGGGGACCAAGGCUGAC-3'   (SEQ ID NO: 2943)
AAT-552 19 nt Target #2:   5'-CCCUGGGGACCAAGGCUGA-3'   (SEQ ID NO: 3083)
AAT-552 19 nt Target #3:   5'-UCCCUGGGGACCAAGGCUG-3'   (SEQ ID NO: 3223)
AAT-556 19 nt Target #1:   5'-GGGACCAAGGCUGACACUC-3'   (SEQ ID NO: 2944)
AAT-556 19 nt Target #2:   5'-GGGGACCAAGGCUGACACU-3'   (SEQ ID NO: 3084)
AAT-556 19 nt Target #3:   5'-UGGGGACCAAGGCUGACAC-3'   (SEQ ID NO: 3224)
AAT-557 19 nt Target #1:   5'-GGACCAAGGCUGACACUCA-3'   (SEQ ID NO: 2945)
AAT-557 19 nt Target #2:   5'-GGGACCAAGGCUGACACUC-3'   (SEQ ID NO: 3085)
AAT-557 19 nt Target #3:   5'-GGGGACCAAGGCUGACACU-3'   (SEQ ID NO: 3225)
AAT-558 19 nt Target #1:   5'-GACCAAGGCUGACACUCAC-3'   (SEQ ID NO: 2946)
AAT-558 19 nt Target #2:   5'-GGACCAAGGCUGACACUCA-3'   (SEQ ID NO: 3086)
AAT-558 19 nt Target #3:   5'-GGGACCAAGGCUGACACUC-3'   (SEQ ID NO: 3226)
AAT-579 19 nt Target #1:   5'-UGAAAUCCUGGAGGGCCUG-3'   (SEQ ID NO: 2947)
AAT-579 19 nt Target #2:   5'-AUGAAAUCCUGGAGGGCCU-3'   (SEQ ID NO: 3087)
AAT-579 19 nt Target #3:   5'-GAUGAAAUCCUGGAGGGCC-3'   (SEQ ID NO: 3227)
AAT-580 19 nt Target #1:   5'-GAAAUCCUGGAGGGCCUGA-3'   (SEQ ID NO: 2948)
AAT-580 19 nt Target #2:   5'-UGAAAUCCUGGAGGGCCUG-3'   (SEQ ID NO: 3088)
AAT-580 19 nt Target #3:   5'-AUGAAAUCCUGGAGGGCCU-3'   (SEQ ID NO: 3228)
AAT-632 19 nt Target #1:   5'-UCCAUGAAGGCUUCCAGGA-3'   (SEQ ID NO: 2949)
AAT-632 19 nt Target #2:   5'-AUCCAUGAAGGCUUCCAGG-3'   (SEQ ID NO: 3089)
AAT-632 19 nt Target #3:   5'-GAUCCAUGAAGGCUUCCAG-3'   (SEQ ID NO: 3229)
AAT-633 19 nt Target #1:   5'-CCAUGAAGGCUUCCAGGAA-3'   (SEQ ID NO: 2950)
AAT-633 19 nt Target #2:   5'-UCCAUGAAGGCUUCCAGGA-3'   (SEQ ID NO: 3090)
AAT-633 19 nt Target #3:   5'-AUCCAUGAAGGCUUCCAGG-3'   (SEQ ID NO: 3230)
AAT-801 19 nt Target #1:   5'-GGACACCGAAGAGGCCAAG-3'   (SEQ ID NO: 2951)
```

TABLE 16-continued

Further DsiRNA Component 19 Nucleotide Target
Sequences in α-1 antitrypsin mRNA

| | | |
|---|---|---|
| AAT-801 19 nt Target #2: | 5'-GGGACACCGAAGAGGCCAA-3' | (SEQ ID NO: 3091) |
| AAT-801 19 nt Target #3: | 5'-GGGGACACCGAAGAGGCCA-3' | (SEQ ID NO: 3231) |
| AAT-802 19 nt Target #1: | 5'-GACACCGAAGAGGCCAAGA-3' | (SEQ ID NO: 2952) |
| AAT-802 19 nt Target #2: | 5'-GGACACCGAAGAGGCCAAG-3' | (SEQ ID NO: 3092) |
| AAT-802 19 nt Target #3: | 5'-GGGACACCGAAGAGGCCAA-3' | (SEQ ID NO: 3232) |
| AAT-803 19 nt Target #1: | 5'-ACACCGAAGAGGCCAAGAA-3' | (SEQ ID NO: 2953) |
| AAT-803 19 nt Target #2: | 5'-GACACCGAAGAGGCCAAGA-3' | (SEQ ID NO: 3093) |
| AAT-803 19 nt Target #3: | 5'-GGACACCGAAGAGGCCAAG-3' | (SEQ ID NO: 3233) |
| AAT-804 19 nt Target #1: | 5'-CACCGAAGAGGCCAAGAAA-3' | (SEQ ID NO: 2954) |
| AAT-804 19 nt Target #2: | 5'-ACACCGAAGAGGCCAAGAA-3' | (SEQ ID NO: 3094) |
| AAT-804 19 nt Target #3: | 5'-GACACCGAAGAGGCCAAGA-3' | (SEQ ID NO: 3234) |
| AAT-805 19 nt Target #1: | 5'-ACCGAAGAGGCCAAGAAAC-3' | (SEQ ID NO: 2955) |
| AAT-805 19 nt Target #2: | 5'-CACCGAAGAGGCCAAGAAA-3' | (SEQ ID NO: 3095) |
| AAT-805 19 nt Target #3: | 5'-ACACCGAAGAGGCCAAGAA-3' | (SEQ ID NO: 3235) |
| AAT-806 19 nt Target #1: | 5'-CCGAAGAGGCCAAGAAACA-3' | (SEQ ID NO: 2956) |
| AAT-806 19 nt Target #2: | 5'-ACCGAAGAGGCCAAGAAAC-3' | (SEQ ID NO: 3096) |
| AAT-806 19 nt Target #3: | 5'-CACCGAAGAGGCCAAGAAA-3' | (SEQ ID NO: 3236) |
| AAT-807 19 nt Target #1: | 5'-CGAAGAGGCCAAGAAACAG-3' | (SEQ ID NO: 2957) |
| AAT-807 19 nt Target #2: | 5'-CCGAAGAGGCCAAGAAACA-3' | (SEQ ID NO: 3097) |
| AAT-807 19 nt Target #3: | 5'-ACCGAAGAGGCCAAGAAAC-3' | (SEQ ID NO: 3237) |
| AAT-808 19 nt Target #1: | 5'-GAAGAGGCCAAGAAACAGA-3' | (SEQ ID NO: 2958) |
| AAT-808 19 nt Target #2: | 5'-CGAAGAGGCCAAGAAACAG-3' | (SEQ ID NO: 3098) |
| AAT-808 19 nt Target #3: | 5'-CCGAAGAGGCCAAGAAACA-3' | (SEQ ID NO: 3238) |
| AAT-809 19 nt Target #1: | 5'-AAGAGGCCAAGAAACAGAU-3' | (SEQ ID NO: 2959) |
| AAT-809 19 nt Target #2: | 5'-GAAGAGGCCAAGAAACAGA-3' | (SEQ ID NO: 3099) |
| AAT-809 19 nt Target #3: | 5'-CGAAGAGGCCAAGAAACAG-3' | (SEQ ID NO: 3239) |
| AAT-810 19 nt Target #1: | 5'-AGAGGCCAAGAAACAGAUC-3' | (SEQ ID NO: 2960) |
| AAT-810 19 nt Target #2: | 5'-AAGAGGCCAAGAAACAGAU-3' | (SEQ ID NO: 3100) |
| AAT-810 19 nt Target #3: | 5'-GAAGAGGCCAAGAAACAGA-3' | (SEQ ID NO: 3240) |
| AAT-811 19 nt Target #1: | 5'-GAGGCCAAGAAACAGAUCA-3' | (SEQ ID NO: 2961) |
| AAT-811 19 nt Target #2: | 5'-AGAGGCCAAGAAACAGAUC-3' | (SEQ ID NO: 3101) |
| AAT-811 19 nt Target #3: | 5'-AAGAGGCCAAGAAACAGAU-3' | (SEQ ID NO: 3241) |
| AAT-812 19 nt Target #1: | 5'-AGGCCAAGAAACAGAUCAA-3' | (SEQ ID NO: 2962) |
| AAT-812 19 nt Target #2: | 5'-GAGGCCAAGAAACAGAUCA-3' | (SEQ ID NO: 3102) |
| AAT-812 19 nt Target #3: | 5'-AGAGGCCAAGAAACAGAUC-3' | (SEQ ID NO: 3242) |
| AAT-813 19 nt Target #1: | 5'-GGCCAAGAAACAGAUCAAC-3' | (SEQ ID NO: 2963) |
| AAT-813 19 nt Target #2: | 5'-AGGCCAAGAAACAGAUCAA-3' | (SEQ ID NO: 3103) |
| AAT-813 19 nt Target #3: | 5'-GAGGCCAAGAAACAGAUCA-3' | (SEQ ID NO: 3243) |
| AAT-900 19 nt Target #1: | 5'-UUUUGCUCUGGUGAAUUAC-3' | (SEQ ID NO: 2964) |

TABLE 16-continued

Further DsiRNA Component 19 Nucleotide Target
Sequences in α-1 antitrypsin mRNA

```
AAT-900 19 nt Target #2:   5'-UUUUUGCUCUGGUGAAUUA-3'   (SEQ ID NO: 3104)

AAT-900 19 nt Target #3:   5'-GUUUUUGCUCUGGUGAAUU-3'   (SEQ ID NO: 3244)

AAT-901 19 nt Target #1:   5'-UUUGCUCUGGUGAAUUACA-3'   (SEQ ID NO: 2965)

AAT-901 19 nt Target #2:   5'-UUUUGCUCUGGUGAAUUAC-3'   (SEQ ID NO: 3105)

AAT-901 19 nt Target #3:   5'-UUUUUGCUCUGGUGAAUUA-3'   (SEQ ID NO: 3245)

AAT-902 19 nt Target #1:   5'-UUGCUCUGGUGAAUUACAU-3'   (SEQ ID NO: 2966)

AAT-902 19 nt Target #2:   5'-UUUGCUCUGGUGAAUUACA-3'   (SEQ ID NO: 3106)

AAT-902 19 nt Target #3:   5'-UUUUGCUCUGGUGAAUUAC-3'   (SEQ ID NO: 3246)

AAT-903 19 nt Target #1:   5'-UGCUCUGGUGAAUUACAUC-3'   (SEQ ID NO: 2967)

AAT-903 19 nt Target #2:   5'-UUGCUCUGGUGAAUUACAU-3'   (SEQ ID NO: 3107)

AAT-903 19 nt Target #3:   5'-UUUGCUCUGGUGAAUUACA-3'   (SEQ ID NO: 3247)

AAT-904 19 nt Target #1:   5'-GCUCUGGUGAAUUACAUCU-3'   (SEQ ID NO: 2968)

AAT-904 19 nt Target #2:   5'-UGCUCUGGUGAAUUACAUC-3'   (SEQ ID NO: 3108)

AAT-904 19 nt Target #3:   5'-UUGCUCUGGUGAAUUACAU-3'   (SEQ ID NO: 3248)

AAT-905 19 nt Target #1:   5'-CUCUGGUGAAUUACAUCUU-3'   (SEQ ID NO: 2969)

AAT-905 19 nt Target #2:   5'-GCUCUGGUGAAUUACAUCU-3'   (SEQ ID NO: 3109)

AAT-905 19 nt Target #3:   5'-UGCUCUGGUGAAUUACAUC-3'   (SEQ ID NO: 3249)

AAT-906 19 nt Target #1:   5'-UCUGGUGAAUUACAUCUUC-3'   (SEQ ID NO: 2970)

AAT-906 19 nt Target #2:   5'-CUCUGGUGAAUUACAUCUU-3'   (SEQ ID NO: 3110)

AAT-906 19 nt Target #3:   5'-GCUCUGGUGAAUUACAUCU-3'   (SEQ ID NO: 3250)

AAT-907 19 nt Target #1:   5'-CUGGUGAAUUACAUCUUCU-3'   (SEQ ID NO: 2971)

AAT-907 19 nt Target #2:   5'-UCUGGUGAAUUACAUCUUC-3'   (SEQ ID NO: 3111)

AAT-907 19 nt Target #3:   5'-CUCUGGUGAAUUACAUCUU-3'   (SEQ ID NO: 3251)

AAT-908 19 nt Target #1:   5'-UGGUGAAUUACAUCUUCUU-3'   (SEQ ID NO: 2972)

AAT-908 19 nt Target #2:   5'-CUGGUGAAUUACAUCUUCU-3'   (SEQ ID NO: 3112)

AAT-908 19 nt Target #3:   5'-UCUGGUGAAUUACAUCUUC-3'   (SEQ ID NO: 3252)

AAT-909 19 nt Target #1:   5'-GGUGAAUUACAUCUUCUUU-3'   (SEQ ID NO: 2973)

AAT-909 19 nt Target #2:   5'-UGGUGAAUUACAUCUUCUU-3'   (SEQ ID NO: 3113)

AAT-909 19 nt Target #3:   5'-CUGGUGAAUUACAUCUUCU-3'   (SEQ ID NO: 3253)

AAT-910 19 nt Target #1:   5'-GUGAAUUACAUCUUCUUUA-3'   (SEQ ID NO: 2974)

AAT-910 19 nt Target #2:   5'-GGUGAAUUACAUCUUCUUU-3'   (SEQ ID NO: 3114)

AAT-910 19 nt Target #3:   5'-UGGUGAAUUACAUCUUCUU-3'   (SEQ ID NO: 3254)

AAT-911 19 nt Target #1:   5'-UGAAUUACAUCUUCUUUAA-3'   (SEQ ID NO: 2975)

AAT-911 19 nt Target #2:   5'-GUGAAUUACAUCUUCUUUA-3'   (SEQ ID NO: 3115)

AAT-911 19 nt Target #3:   5'-GGUGAAUUACAUCUUCUUU-3'   (SEQ ID NO: 3255)

AAT-912 19 nt Target #1:   5'-GAAUUACAUCUUCUUUAAA-3'   (SEQ ID NO: 2976)

AAT-912 19 nt Target #2:   5'-UGAAUUACAUCUUCUUUAA-3'   (SEQ ID NO: 3116)

AAT-912 19 nt Target #3:   5'-GUGAAUUACAUCUUCUUUA-3'   (SEQ ID NO: 3256)
```

TABLE 16-continued

Further DsiRNA Component 19 Nucleotide Target
Sequences in α-1 antitrypsin mRNA

| | | |
|---|---|---|
| AAT-913 19 nt Target #1: | 5'-AAUUACAUCUUCUUUAAAG-3' | (SEQ ID NO: 2977) |
| AAT-913 19 nt Target #2: | 5'-GAAUUACAUCUUCUUUAAA-3' | (SEQ ID NO: 3117) |
| AAT-913 19 nt Target #3: | 5'-UGAAUUACAUCUUCUUUAA-3' | (SEQ ID NO: 3257) |
| AAT-914 19 nt Target #1: | 5'-AUUACAUCUUCUUUAAAGG-3' | (SEQ ID NO: 2978) |
| AAT-914 19 nt Target #2: | 5'-AAUUACAUCUUCUUUAAAG-3' | (SEQ ID NO: 3118) |
| AAT-914 19 nt Target #3: | 5'-GAAUUACAUCUUCUUUAAA-3' | (SEQ ID NO: 3258) |
| AAT-915 19 nt Target #1: | 5'-UUACAUCUUCUUUAAAGGC-3' | (SEQ ID NO: 2979) |
| AAT-915 19 nt Target #2: | 5'-AUUACAUCUUCUUUAAAGG-3' | (SEQ ID NO: 3119) |
| AAT-915 19 nt Target #3: | 5'-AAUUACAUCUUCUUUAAAG-3' | (SEQ ID NO: 3259) |
| AAT-916 19 nt Target #1: | 5'-UACAUCUUCUUUAAAGGCA-3' | (SEQ ID NO: 2980) |
| AAT-916 19 nt Target #2: | 5'-UUACAUCUUCUUUAAAGGC-3' | (SEQ ID NO: 3120) |
| AAT-916 19 nt Target #3: | 5'-AUUACAUCUUCUUUAAAGG-3' | (SEQ ID NO: 3260) |
| AAT-917 19 nt Target #1: | 5'-ACAUCUUCUUUAAAGGCAA-3' | (SEQ ID NO: 2981) |
| AAT-917 19 nt Target #2: | 5'-UACAUCUUCUUUAAAGGCA-3' | (SEQ ID NO: 3121) |
| AAT-917 19 nt Target #3: | 5'-UUACAUCUUCUUUAAAGGC-3' | (SEQ ID NO: 3261) |
| AAT-918 19 nt Target #1: | 5'-CAUCUUCUUUAAAGGCAAA-3' | (SEQ ID NO: 2982) |
| AAT-918 19 nt Target #2: | 5'-ACAUCUUCUUUAAAGGCAA-3' | (SEQ ID NO: 3122) |
| AAT-918 19 nt Target #3: | 5'-UACAUCUUCUUUAAAGGCA-3' | (SEQ ID NO: 3262) |
| AAT-922 19 nt Target #1: | 5'-UUCUUUAAAGGCAAAUGGG-3' | (SEQ ID NO: 2983) |
| AAT-922 19 nt Target #2: | 5'-CUUCUUUAAAGGCAAAUGG-3' | (SEQ ID NO: 3123) |
| AAT-922 19 nt Target #3: | 5'-UCUUCUUUAAAGGCAAAUG-3' | (SEQ ID NO: 3263) |
| AAT-924 19 nt Target #1: | 5'-CUUUAAAGGCAAAUGGGAG-3' | (SEQ ID NO: 2984) |
| AAT-924 19 nt Target #2: | 5'-UCUUUAAAGGCAAAUGGGA-3' | (SEQ ID NO: 3124) |
| AAT-924 19 nt Target #3: | 5'-UUCUUUAAAGGCAAAUGGG-3' | (SEQ ID NO: 3264) |
| AAT-932 19 nt Target #1: | 5'-GCAAAUGGGAGAGACCCUU-3' | (SEQ ID NO: 2985) |
| AAT-932 19 nt Target #2: | 5'-GGCAAAUGGGAGAGACCCU-3' | (SEQ ID NO: 3125) |
| AAT-932 19 nt Target #3: | 5'-AGGCAAAUGGGAGAGACCC-3' | (SEQ ID NO: 3265) |
| AAT-933 19 nt Target #1: | 5'-CAAAUGGGAGAGACCCUUU-3' | (SEQ ID NO: 2986) |
| AAT-933 19 nt Target #2: | 5'-GCAAAUGGGAGAGACCCUU-3' | (SEQ ID NO: 3126) |
| AAT-933 19 nt Target #3: | 5'-GGCAAAUGGGAGAGACCCU-3' | (SEQ ID NO: 3266) |
| AAT-934 19 nt Target #1: | 5'-AAAUGGGAGAGACCCUUUG-3' | (SEQ ID NO: 2987) |
| AAT-934 19 nt Target #2: | 5'-CAAAUGGGAGAGACCCUUU-3' | (SEQ ID NO: 3127) |
| AAT-934 19 nt Target #3: | 5'-GCAAAUGGGAGAGACCCUU-3' | (SEQ ID NO: 3267) |
| AAT-935 19 nt Target #1: | 5'-AAUGGGAGAGACCCUUUGA-3' | (SEQ ID NO: 2988) |
| AAT-935 19 nt Target #2: | 5'-AAAUGGGAGAGACCCUUUG-3' | (SEQ ID NO: 3128) |
| AAT-935 19 nt Target #3: | 5'-CAAAUGGGAGAGACCCUUU-3' | (SEQ ID NO: 3268) |
| AAT-1061 19 nt Target #1: | 5'-UGUCCAGCUGGGUGCUGCU-3' | (SEQ ID NO: 2989) |
| AAT-1061 19 nt Target #2: | 5'-CUGUCCAGCUGGGUGCUGC-3' | (SEQ ID NO: 3129) |
| AAT-1061 19 nt Target #3: | 5'-GCUGUCCAGCUGGGUGCUG-3' | (SEQ ID NO: 3269) |

TABLE 16-continued

Further DsiRNA Component 19 Nucleotide Target
Sequences in α-1 antitrypsin mRNA

```
AAT-1062 19 nt Target #1:  5'-GUCCAGCUGGGUGCUGCUG-3'  (SEQ ID NO: 2990)

AAT-1062 19 nt Target #2:  5'-UGUCCAGCUGGGUGCUGCU-3'  (SEQ ID NO: 3130)

AAT-1062 19 nt Target #3:  5'-CUGUCCAGCUGGGUGCUGC-3'  (SEQ ID NO: 3270)

AAT-1063 19 nt Target #1:  5'-UCCAGCUGGGUGCUGCUGA-3'  (SEQ ID NO: 2991)

AAT-1063 19 nt Target #2:  5'-GUCCAGCUGGGUGCUGCUG-3'  (SEQ ID NO: 3131)

AAT-1063 19 nt Target #3:  5'-UGUCCAGCUGGGUGCUGCU-3'  (SEQ ID NO: 3271)

AAT-1064 19 nt Target #1:  5'-CCAGCUGGGUGCUGCUGAU-3'  (SEQ ID NO: 2992)

AAT-1064 19 nt Target #2:  5'-UCCAGCUGGGUGCUGCUGA-3'  (SEQ ID NO: 3132)

AAT-1064 19 nt Target #3:  5'-GUCCAGCUGGGUGCUGCUG-3'  (SEQ ID NO: 3272)

AAT-1065 19 nt Target #1:  5'-CAGCUGGGUGCUGCUGAUG-3'  (SEQ ID NO: 2993)

AAT-1065 19 nt Target #2:  5'-CCAGCUGGGUGCUGCUGAU-3'  (SEQ ID NO: 3133)

AAT-1065 19 nt Target #3:  5'-UCCAGCUGGGUGCUGCUGA-3'  (SEQ ID NO: 3273)

AAT-1066 19 nt Target #1:  5'-AGCUGGGUGCUGCUGAUGA-3'  (SEQ ID NO: 2994)

AAT-1066 19 nt Target #2:  5'-CAGCUGGGUGCUGCUGAUG-3'  (SEQ ID NO: 3134)

AAT-1066 19 nt Target #3:  5'-CCAGCUGGGUGCUGCUGAU-3'  (SEQ ID NO: 3274)

AAT-1067 19 nt Target #1:  5'-GCUGGGUGCUGCUGAUGAA-3'  (SEQ ID NO: 2995)

AAT-1067 19 nt Target #2:  5'-AGCUGGGUGCUGCUGAUGA-3'  (SEQ ID NO: 3135)

AAT-1067 19 nt Target #3:  5'-CAGCUGGGUGCUGCUGAUG-3'  (SEQ ID NO: 3275)

AAT-1068 19 nt Target #1:  5'-CUGGGUGCUGCUGAUGAAA-3'  (SEQ ID NO: 2996)

AAT-1068 19 nt Target #2:  5'-GCUGGGUGCUGCUGAUGAA-3'  (SEQ ID NO: 3136)

AAT-1068 19 nt Target #3:  5'-AGCUGGGUGCUGCUGAUGA-3'  (SEQ ID NO: 3276)

AAT-1069 19 nt Target #1:  5'-UGGGUGCUGCUGAUGAAAU-3'  (SEQ ID NO: 2997)

AAT-1069 19 nt Target #2:  5'-CUGGGUGCUGCUGAUGAAA-3'  (SEQ ID NO: 3137)

AAT-1069 19 nt Target #3:  5'-GCUGGGUGCUGCUGAUGAA-3'  (SEQ ID NO: 3277)

AAT-1070 19 nt Target #1:  5'-GGGUGCUGCUGAUGAAAUA-3'  (SEQ ID NO: 2998)

AAT-1070 19 nt Target #2:  5'-UGGGUGCUGCUGAUGAAAU-3'  (SEQ ID NO: 3138)

AAT-1070 19 nt Target #3:  5'-CUGGGUGCUGCUGAUGAAA-3'  (SEQ ID NO: 3278)

AAT-1072 19 nt Target #1:  5'-GUGCUGCUGAUGAAAUACC-3'  (SEQ ID NO: 2999)

AAT-1072 19 nt Target #2:  5'-GGUGCUGCUGAUGAAAUAC-3'  (SEQ ID NO: 3139)

AAT-1072 19 nt Target #3:  5'-GGGUGCUGCUGAUGAAAUA-3'  (SEQ ID NO: 3279)

AAT-1073 19 nt Target #1:  5'-UGCUGCUGAUGAAAUACCU-3'  (SEQ ID NO: 3000)

AAT-1073 19 nt Target #2:  5'-GUGCUGCUGAUGAAAUACC-3'  (SEQ ID NO: 3140)

AAT-1073 19 nt Target #3:  5'-GGUGCUGCUGAUGAAAUAC-3'  (SEQ ID NO: 3280)

AAT-1074 19 nt Target #1:  5'-GCUGCUGAUGAAAUACCUG-3'  (SEQ ID NO: 3001)

AAT-1074 19 nt Target #2:  5'-UGCUGCUGAUGAAAUACCU-3'  (SEQ ID NO: 3141)

AAT-1074 19 nt Target #3:  5'-GUGCUGCUGAUGAAAUACC-3'  (SEQ ID NO: 3281)

AAT-1075 19 nt Target #1:  5'-CUGCUGAUGAAAUACCGG-3'  (SEQ ID NO: 3002)

AAT-1075 19 nt Target #2:  5'-GCUGCUGAUGAAAUACCUG-3'  (SEQ ID NO: 3142)
```

TABLE 16-continued

Further DsiRNA Component 19 Nucleotide Target
Sequences in α-1 antitrypsin mRNA

| | | |
|---|---|---|
| AAT-1075 19 nt Target #3: | 5'-UGCUGCUGAUGAAAUACCU-3' | (SEQ ID NO: 3282) |
| AAT-1076 19 nt Target #1: | 5'-UGCUGAUGAAAUACCUGGG-3' | (SEQ ID NO: 3003) |
| AAT-1076 19 nt Target #2: | 5'-CUGCUGAUGAAAUACCUGG-3' | (SEQ ID NO: 3143) |
| AAT-1076 19 nt Target #3: | 5'-GCUGCUGAUGAAAUACCUG-3' | (SEQ ID NO: 3283) |
| AAT-1077 19 nt Target #1: | 5'-GCUGAUGAAAUACCUGGGC-3' | (SEQ ID NO: 3004) |
| AAT-1077 19 nt Target #2: | 5'-UGCUGAUGAAAUACCUGGG-3' | (SEQ ID NO: 3144) |
| AAT-1077 19 nt Target #3: | 5'-CUGCUGAUGAAAUACCUGG-3' | (SEQ ID NO: 3284) |
| AAT-1078 19 nt Target #1: | 5'-CUGAUGAAAUACCUGGGCA-3' | (SEQ ID NO: 3005) |
| AAT-1078 19 nt Target #2: | 5'-GCUGAUGAAAUACCUGGGC-3' | (SEQ ID NO: 3145) |
| AAT-1078 19 nt Target #3: | 5'-UGCUGAUGAAAUACCUGGG-3' | (SEQ ID NO: 3285) |
| AAT-1079 19 nt Target #1: | 5'-UGAUGAAAUACCUGGGCAA-3' | (SEQ ID NO: 3006) |
| AAT-1079 19 nt Target #2: | 5'-CUGAUGAAAUACCUGGGCA-3' | (SEQ ID NO: 3146) |
| AAT-1079 19 nt Target #3: | 5'-GCUGAUGAAAUACCUGGGC-3' | (SEQ ID NO: 3286) |
| AAT-1080 19 nt Target #1: | 5'-GAUGAAAUACCUGGGCAAU-3' | (SEQ ID NO: 3007) |
| AAT-1080 19 nt Target #2: | 5'-UGAUGAAAUACCUGGGCAA-3' | (SEQ ID NO: 3147) |
| AAT-1080 19 nt Target #3: | 5'-CUGAUGAAAUACCUGGGCA-3' | (SEQ ID NO: 3287) |
| AAT-1081 19 nt Target #1: | 5'-AUGAAAUACCUGGGCAAUG-3' | (SEQ ID NO: 3008) |
| AAT-1081 19 nt Target #2: | 5'-GAUGAAAUACCUGGGCAAU-3' | (SEQ ID NO: 3148) |
| AAT-1081 19 nt Target #3: | 5'-UGAUGAAAUACCUGGGCAA-3' | (SEQ ID NO: 3288) |
| AAT-1083 19 nt Target #1: | 5'-GAAAUACCUGGGCAAUGCC-3' | (SEQ ID NO: 3009) |
| AAT-1083 19 nt Target #2: | 5'-UGAAAUACCUGGGCAAUGC-3' | (SEQ ID NO: 3149) |
| AAT-1083 19 nt Target #3: | 5'-AUGAAAUACCUGGGCAAUG-3' | (SEQ ID NO: 3289) |
| AAT-1138 19 nt Target #1: | 5'-CAGCACCUGGAAAAUGAAC-3' | (SEQ ID NO: 3010) |
| AAT-1138 19 nt Target #2: | 5'-ACAGCACCUGGAAAAUGAA-3' | (SEQ ID NO: 3150) |
| AAT-1138 19 nt Target #3: | 5'-UACAGCACCUGGAAAAUGA-3' | (SEQ ID NO: 3290) |
| AAT-1144 19 nt Target #1: | 5'-CUGGAAAAUGAACUCACCC-3' | (SEQ ID NO: 3011) |
| AAT-1144 19 nt Target #2: | 5'-CCUGGAAAAUGAACUCACC-3' | (SEQ ID NO: 3151) |
| AAT-1144 19 nt Target #3: | 5'-ACCUGGAAAAUGAACUCAC-3' | (SEQ ID NO: 3291) |
| AAT-1145 19 nt Target #1: | 5'-UGGAAAAUGAACUCACCCA-3' | (SEQ ID NO: 3012) |
| AAT-1145 19 nt Target #2: | 5'-CUGGAAAAUGAACUCACCC-3' | (SEQ ID NO: 3152) |
| AAT-1145 19 nt Target #3: | 5'-CCUGGAAAAUGAACUCACC-3' | (SEQ ID NO: 3292) |
| AAT-1165 19 nt Target #1: | 5'-GAUAUCAUCACCAAGUUCC-3' | (SEQ ID NO: 3013) |
| AAT-1165 19 nt Target #2: | 5'-CGAUAUCAUCACCAAGUUC-3' | (SEQ ID NO: 3153) |
| AAT-1165 19 nt Target #3: | 5'-ACGAUAUCAUCACCAAGUU-3' | (SEQ ID NO: 3293) |
| AAT-1176 19 nt Target #1: | 5'-CAAGUUCCUGGAAAAUGAA-3' | (SEQ ID NO: 3014) |
| AAT-1176 19 nt Target #2: | 5'-CCAAGUUCCUGGAAAAUGA-3' | (SEQ ID NO: 3154) |
| AAT-1176 19 nt Target #3: | 5'-ACCAAGUUCCUGGAAAAUG-3' | (SEQ ID NO: 3294) |
| AAT-1232 19 nt Target #1: | 5'-CCAUUACUGGAACCUAUGA-3' | (SEQ ID NO: 3015) |
| AAT-1232 19 nt Target #2: | 5'-UCCAUUACUGGAACCUAUG-3' | (SEQ ID NO: 3155) |

TABLE 16-continued

Further DsiRNA Component 19 Nucleotide Target
Sequences in α-1 antitrypsin mRNA

```
AAT-1232 19 nt Target #3:   5'-GUCCAUUACUGGAACCUAU-3'   (SEQ ID NO: 3295)

AAT-1233 19 nt Target #1:   5'-CAUUACUGGAACCUAUGAU-3'   (SEQ ID NO: 3016)

AAT-1233 19 nt Target #2:   5'-CCAUUACUGGAACCUAUGA-3'   (SEQ ID NO: 3156)

AAT-1233 19 nt Target #3:   5'-UCCAUUACUGGAACCUAUG-3'   (SEQ ID NO: 3296)

AAT-1234 19 nt Target #1:   5'-AUUACUGGAACCUAUGAUC-3'   (SEQ ID NO: 3017)

AAT-1234 19 nt Target #2:   5'-CAUUACUGGAACCUAUGAU-3'   (SEQ ID NO: 3157)

AAT-1234 19 nt Target #3:   5'-CCAUUACUGGAACCUAUGA-3'   (SEQ ID NO: 3297)

AAT-1235 19 nt Target #1:   5'-UUACUGGAACCUAUGAUCU-3'   (SEQ ID NO: 3018)

AAT-1235 19 nt Target #2:   5'-AUUACUGGAACCUAUGAUC-3'   (SEQ ID NO: 3158)

AAT-1235 19 nt Target #3:   5'-CAUUACUGGAACCUAUGAU-3'   (SEQ ID NO: 3298)

AAT-1236 19 nt Target #1:   5'-UACUGGAACCUAUGAUCUG-3'   (SEQ ID NO: 3019)

AAT-1236 19 nt Target #2:   5'-UUACUGGAACCUAUGAUCU-3'   (SEQ ID NO: 3159)

AAT-1236 19 nt Target #3:   5'-AUUACUGGAACCUAUGAUC-3'   (SEQ ID NO: 3299)

AAT-1237 19 nt Target #1:   5'-ACUGGAACCUAUGAUCUGA-3'   (SEQ ID NO: 3020)

AAT-1237 19 nt Target #2:   5'-UACUGGAACCUAUGAUCUG-3'   (SEQ ID NO: 3160)

AAT-1237 19 nt Target #3:   5'-UUACUGGAACCUAUGAUCU-3'   (SEQ ID NO: 3300)

AAT-1238 19 nt Target #1:   5'-CUGGAACCUAUGAUCUGAA-3'   (SEQ ID NO: 3021)

AAT-1238 19 nt Target #2:   5'-ACUGGAACCUAUGAUCUGA-3'   (SEQ ID NO: 3161)

AAT-1238 19 nt Target #3:   5'-UACUGGAACCUAUGAUCUG-3'   (SEQ ID NO: 3301)

AAT-1239 19 nt Target #1:   5'-UGGAACCUAUGAUCUGAAG-3'   (SEQ ID NO: 3022)

AAT-1239 19 nt Target #2:   5'-CUGGAACCUAUGAUCUGAA-3'   (SEQ ID NO: 3162)

AAT-1239 19 nt Target #3:   5'-ACUGGAACCUAUGAUCUGA-3'   (SEQ ID NO: 3302)

AAT-1240 19 nt Target #1:   5'-GGAACCUAUGAUCUGAAGA-3'   (SEQ ID NO: 3023)

AAT-1240 19 nt Target #2:   5'-UGGAACCUAUGAUCUGAAG-3'   (SEQ ID NO: 3163)

AAT-1240 19 nt Target #3:   5'-CUGGAACCUAUGAUCUGAA-3'   (SEQ ID NO: 3303)

AAT-1279 19 nt Target #1:   5'-AUCACUAAGGUCUUCAGCA-3'   (SEQ ID NO: 3024)

AAT-1279 19 nt Target #2:   5'-CAUCACUAAGGUCUUCAGC-3'   (SEQ ID NO: 3164)

AAT-1279 19 nt Target #3:   5'-GCAUCACUAAGGUCUUCAG-3'   (SEQ ID NO: 3304)

AAT-1280 19 nt Target #1:   5'-UCACUAAGGUCUUCAGCAA-3'   (SEQ ID NO: 3025)

AAT-1280 19 nt Target #2:   5'-AUCACUAAGGUCUUCAGCA-3'   (SEQ ID NO: 3165)

AAT-1280 19 nt Target #3:   5'-CAUCACUAAGGUCUUCAGC-3'   (SEQ ID NO: 3305)

AAT-1281 19 nt Target #1:   5'-CACUAAGGUCUUCAGCAAU-3'   (SEQ ID NO: 3026)

AAT-1281 19 nt Target #2:   5'-UCACUAAGGUCUUCAGCAA-3'   (SEQ ID NO: 3166)

AAT-1281 19 nt Target #3:   5'-AUCACUAAGGUCUUCAGCA-3'   (SEQ ID NO: 3306)

AAT-1283 19 nt Target #1:   5'-CUAAGGUCUUCAGCAAUGG-3'   (SEQ ID NO: 3027)

AAT-1283 19 nt Target #2:   5'-ACUAAGGUCUUCAGCAAUG-3'   (SEQ ID NO: 3167)

AAT-1283 19 nt Target #3:   5'-CACUAAGGUCUUCAGCAAU-3'   (SEQ ID NO: 3307)

AAT-1284 19 nt Target #1:   5'-UAAGGUCUUCAGCAAUGGG-3'   (SEQ ID NO: 3028)
```

TABLE 16-continued

Further DsiRNA Component 19 Nucleotide Target
Sequences in α-1 antitrypsin mRNA

| | | |
|---|---|---|
| AAT-1284 19 nt Target #2: | 5'-CUAAGGUCUUCAGCAAUGG-3' | (SEQ ID NO: 3168) |
| AAT-1284 19 nt Target #3: | 5'-ACUAAGGUCUUCAGCAAUG-3' | (SEQ ID NO: 3308) |
| AAT-1337 19 nt Target #1: | 5'-UGAAGCUCUCCAAGGCCGU-3' | (SEQ ID NO: 3029) |
| AAT-1337 19 nt Target #2: | 5'-CUGAAGCUCUCCAAGGCCG-3' | (SEQ ID NO: 3169) |
| AAT-1337 19 nt Target #3: | 5'-CCUGAAGCUCUCCAAGGCC-3' | (SEQ ID NO: 3309) |
| AAT-1338 19 nt Target #1: | 5'-GAAGCUCUCCAAGGCCGUG-3' | (SEQ ID NO: 3030) |
| AAT-1338 19 nt Target #2: | 5'-UGAAGCUCUCCAAGGCCGU-3' | (SEQ ID NO: 3170) |
| AAT-1338 19 nt Target #3: | 5'-CUGAAGCUCUCCAAGGCCG-3' | (SEQ ID NO: 3310) |
| AAT-1339 19 nt Target #1: | 5'-AAGCUCUCCAAGGCCGUGC-3' | (SEQ ID NO: 3031) |
| AAT-1339 19 nt Target #2: | 5'-GAAGCUCUCCAAGGCCGUG-3' | (SEQ ID NO: 3171) |
| AAT-1339 19 nt Target #3: | 5'-UGAAGCUCUCCAAGGCCGU-3' | (SEQ ID NO: 3311) |
| AAT-1442 19 nt Target #1: | 5'-CCGAGGUCAAGUUCAACAA-3' | (SEQ ID NO: 3032) |
| AAT-1442 19 nt Target #2: | 5'-CCCGAGGUCAAGUUCAACA-3' | (SEQ ID NO: 3172) |
| AAT-1442 19 nt Target #3: | 5'-CCCCGAGGUCAAGUUCAAC-3' | (SEQ ID NO: 3312) |
| AAT-1443 19 nt Target #1: | 5'-CGAGGUCAAGUUCAACAAA-3' | (SEQ ID NO: 3033) |
| AAT-1443 19 nt Target #2: | 5'-CCGAGGUCAAGUUCAACAA-3' | (SEQ ID NO: 3173) |
| AAT-1443 19 nt Target #3: | 5'-CCCGAGGUCAAGUUCAACA-3' | (SEQ ID NO: 3313) |
| AAT-1444 19 nt Target #1: | 5'-GAGGUCAAGUUCAACAAAC-3' | (SEQ ID NO: 3034) |
| AAT-1444 19 nt Target #2: | 5'-CGAGGUCAAGUUCAACAAA-3' | (SEQ ID NO: 3174) |
| AAT-1444 19 nt Target #3: | 5'-CCGAGGUCAAGUUCAACAA-3' | (SEQ ID NO: 3314) |
| AAT-1445 19 nt Target #1: | 5'-AGGUCAAGUUCAACAAACC-3' | (SEQ ID NO: 3035) |
| AAT-1445 19 nt Target #2: | 5'-GAGGUCAAGUUCAACAAAC-3' | (SEQ ID NO: 3175) |
| AAT-1445 19 nt Target #3: | 5'-CGAGGUCAAGUUCAACAAA-3' | (SEQ ID NO: 3315) |
| AAT-1446 19 nt Target #1: | 5'-GGUCAAGUUCAACAAACCC-3' | (SEQ ID NO: 3036) |
| AAT-1446 19 nt Target #2: | 5'-AGGUCAAGUUCAACAAACC-3' | (SEQ ID NO: 3176) |
| AAT-1446 19 nt Target #3: | 5'-GAGGUCAAGUUCAACAAAC-3' | (SEQ ID NO: 3316) |
| AAT-1447 19 nt Target #1: | 5'-GUCAAGUUCAACAAACCCU-3' | (SEQ ID NO: 3037) |
| AAT-1447 19 nt Target #2: | 5'-GGUCAAGUUCAACAAACCC-3' | (SEQ ID NO: 3177) |
| AAT-1447 19 nt Target #3: | 5'-AGGUCAAGUUCAACAAACC-3' | (SEQ ID NO: 3317) |
| AAT-1448 19 nt Target #1: | 5'-UCAAGUUCAACAAACCCUU-3' | (SEQ ID NO: 3038) |
| AAT-1448 19 nt Target #2: | 5'-GUCAAGUUCAACAAACCCU-3' | (SEQ ID NO: 3178) |
| AAT-1448 19 nt Target #3: | 5'-GGUCAAGUUCAACAAACCC-3' | (SEQ ID NO: 3318) |
| AAT-1449 19 nt Target #1: | 5'-CAAGUUCAACAAACCCUUU-3' | (SEQ ID NO: 3039) |
| AAT-1449 19 nt Target #2: | 5'-UCAAGUUCAACAAACCCUU-3' | (SEQ ID NO: 3179) |
| AAT-1449 19 nt Target #3: | 5'-GUCAAGUUCAACAAACCCU-3' | (SEQ ID NO: 3319) |
| AAT-1450 19 nt Target #1: | 5'-AAGUUCAACAAACCCUUUG-3' | (SEQ ID NO: 3040) |
| AAT-1450 19 nt Target #2: | 5'-CAAGUUCAACAAACCCUUU-3' | (SEQ ID NO: 3180) |
| AAT-1450 19 nt Target #3: | 5'-UCAAGUUCAACAAACCCUU-3' | (SEQ ID NO: 3320) |
| AAT-1451 19 nt Target #1: | 5'-AGUUCAACAAACCCUUUGU-3' | (SEQ ID NO: 3041) |

TABLE 16-continued

Further DsiRNA Component 19 Nucleotide Target
Sequences in α-1 antitrypsin mRNA

AAT-1451 19 nt Target #2:  5'-AAGUUCAACAAACCCUUUG-3'  (SEQ ID NO: 3181)

AAT-1451 19 nt Target #3:  5'-CAAGUUCAACAAACCCUUU-3'  (SEQ ID NO: 3321)

TABLE 17

Other Human Anti-α-1 antitrypsin DsiRNA Agents (Asymmetrics)

```
                 5'-CCCCAGGGAGAUGCUGCCCAGAAga-3'       (SEQ ID NO: 3358)
                 3'-UAGGGGUCCCUCUACGACGGGUCUUCU-5'     (SEQ ID NO: 3373)
AAT-364 Target:  5'-ATCCCCAGGGAGATGCTGCCCAGAAGA-3'     (SEQ ID NO: 3388)

5'-GCCUUUGCAAUGCUCUCCCUGGGga-3'       (SEQ ID NO: 3359)
                 3'-GUCGGAAACGUUACGAGAGGGACCCCU-5'     (SEQ ID NO: 3374)
AAT-535 Target:  5'-CAGCCTTTGCAATGCTCTCCCTGGGGA-3'     (SEQ ID NO: 3389)

5'-GCAAUGCUCUCCCUGGGGACCAAgg-3'       (SEQ ID NO: 3360)
                 3'-AACGUUACGAGAGGGACCCCUGGUUCC-5'     (SEQ ID NO: 3375)
AAT-541 Target:  5'-TTGCAATGCTCTCCCTGGGGACCAAGG-3'     (SEQ ID NO: 3390)

5'-GGGGACCAAGGCUGACACUCACGat-3'       (SEQ ID NO: 3361)
                 3'-GACCCCUGGUUCCGACUGUGAGUGCUA-5'     (SEQ ID NO: 3376)
AAT-555 Target:  5'-CTGGGGACCAAGGCTGACACTCACGAT-3'     (SEQ ID NO: 3391)

5'-UCCUGGAGGGCCUGAAUUUCAACct-3'       (SEQ ID NO: 3362)
                 3'-UUAGGACCUCCCGGACUUAAAGUUGGA-5'     (SEQ ID NO: 3377)
AAT-584 Target:  5'-AATCCTGGAGGGCCTGAATTTCAACCT-3'     (SEQ ID NO: 3392)

5'-CAGACAGCCAGCUCCAGCUGACCac-3'       (SEQ ID NO: 3363)
                 3'-CGGUCUGUCGGUCGAGGUCGACUGGUG-5'     (SEQ ID NO: 3378)
AAT-674 Target:  5'-GCCAGACAGCCAGCTCCAGCTGACCAC-3'     (SEQ ID NO: 3393)

5'-AUCUUCUUUAAAGGCAAAUGGGAga-3'       (SEQ ID NO: 3364)
                 3'-UGUAGAAGAAAUUUCCGUUUACCCUCU-5'     (SEQ ID NO: 3379)
AAT-919 Target:  5'-ACATCTTCTTTAAAGGCAAATGGGAGA-3'     (SEQ ID NO: 3394)

5'-UUAAAGGCAAAUGGGAGAGACCCtt-3'       (SEQ ID NO: 3365)
                 3'-GAAAUUUCCGUUUACCCUCUCUGGGAA-5'     (SEQ ID NO: 3380)
AAT-926 Target:  5'-CTTTAAAGGCAAATGGGAGAGACCCTT-3'     (SEQ ID NO: 3395)

5'-UAAAGGCAAAUGGGAGAGACCCUtt-3'       (SEQ ID NO: 3366)
                 3'-AAAUUUCCGUUUACCCUCUCUGGGAAA-5'     (SEQ ID NO: 3381)
AAT-927 Target:  5'-TTTAAAGGCAAATGGGAGAGACCCTTT-3'     (SEQ ID NO: 3396)

5'-AGAAGCUGUCCAGCUGGGUGCUGct-3'       (SEQ ID NO: 3367)
                 3'-AUUCUUCGACAGGUCGACCCACGACGA-5'     (SEQ ID NO: 3382)
AAT-1055 Target: 5'-TAAGAAGCTGTCCAGCTGGGTGCTGCT-3'     (SEQ ID NO: 3397)

5'-AUGCCACCGCCAUCUUCUUCCUGcc-3'       (SEQ ID NO: 3368)
                 3'-GUUACGGUGGCGGUAGAAGAAGGACGG-5'     (SEQ ID NO: 3383)
AAT-1097 Target: 5'-CAATGCCACCGCCATCTTCTTCCTGCC-3'     (SEQ ID NO: 3398)

5'-GCCACCGCCAUCUUCUUCCUGCCtg-3'       (SEQ ID NO: 3369)
                 3'-UACGGUGGCGGUAGAAGAAGGACGGAC-5'     (SEQ ID NO: 3384)
AAT-1099 Target: 5'-ATGCCACCGCCATCTTCTTCCTGCCTG-3'     (SEQ ID NO: 3399)

5'-AGGAGGCACCCCUGAAGCUCUCCaa-3'       (SEQ ID NO: 3370)
                 3'-UCUCCUCCGUGGGGACUUCGAGAGGUU-5'     (SEQ ID NO: 3385)
AAT-1325 Target: 5'-AGAGGAGGCACCCCTGAAGCTCTCCAA-3'     (SEQ ID NO: 3400)

5'-AAGGCCGUGCAUAAGGCUGUGCUga-3'       (SEQ ID NO: 3371)
                 3'-GGUUCCGGCACGUAUUCCGACACGACU-5'     (SEQ ID NO: 3386)
AAT-1348 Target: 5'-CCAAGGCCGTGCATAAGGCTGTGCTGA-3'     (SEQ ID NO: 3401)

5'-CCGUGCAUAAGGCUGUGCUGACCat-3'       (SEQ ID NO: 3372)
                 3'-CCGGCACGUAUUCCGACACGACUGGUA-5'     (SEQ ID NO: 3387)
AAT-1352 Target: 5'-GGCCGTGCATAAGGCTGTGCTGACCAT-3'     (SEQ ID NO: 3402)
```

TABLE 18

Other Human Anti-α-1 antitrypsin DsiRNAs, Unmodified Duplexes (Asymmetrics)

| | | |
|---|---|---|
| | 5'-CCCCAGGGAGAUGCUGCCCAGAAGA-3' | (SEQ ID NO: 3403) |
| | 3'-UAGGGGUCCCUCUACGACGGGUCUUCU-5' | (SEQ ID NO: 3373) |
| AAT-364 Target: | 5'-ATCCCCAGGGAGATGCTGCCCAGAAGA-3' | (SEQ ID NO: 3388) |
| | 5'-GCCUUUGCAAUGCUCUCCCUGGGGA-3' | (SEQ ID NO: 3404) |
| | 3'-GUCGGAAACGUUACGAGAGGGACCCCU-5' | (SEQ ID NO: 3374) |
| AAT-535 Target: | 5'-CAGCCTTTGCAATGCTCTCCCTGGGGA-3' | (SEQ ID NO: 3389) |
| | 5'-GCAAUGCUCUCCCUGGGGACCAAGG-3' | (SEQ ID NO: 3405) |
| | 3'-AACGUUACGAGAGGGACCCCUGGUUCC-5' | (SEQ ID NO: 3375) |
| AAT-541 Target: | 5'-TTGCAATGCTCTCCCTGGGGACCAAGG-3' | (SEQ ID NO: 3390) |
| | 5'-GGGGACCAAGGCUGACACUCACGAU-3' | (SEQ ID NO: 3406) |
| | 3'-GACCCCUGGUUCCGACUGUGAGUGCUA-5' | (SEQ ID NO: 3376) |
| AAT-555 Target: | 5'-CTGGGGACCAAGGCTGACACTCACGAT-3' | (SEQ ID NO: 3391) |
| | 5'-UCCUGGAGGGCCUGAAUUUCAACCU-3' | (SEQ ID NO: 3407) |
| | 3'-UUAGGACCUCCCGGACUUAAAGUUGGA-5' | (SEQ ID NO: 3377) |
| AAT-584 Target: | 5'-AATCCTGGAGGGCCTGAATTTCAACCT-3' | (SEQ ID NO: 3392) |
| | 5'-CAGACAGCCAGCUCCAGCUGACCAC-3' | (SEQ ID NO: 3408) |
| | 3'-CGGUCUGUCGGUCGAGGUCGACUGGUG-5' | (SEQ ID NO: 3378) |
| AAT-674 Target: | 5'-GCCAGACAGCCAGCTCCAGCTGACCAC-3' | (SEQ ID NO: 3393) |
| | 5'-AUCUUCUUUAAAGGCAAAUGGGAGA-3' | (SEQ ID NO: 3409) |
| | 3'-UGUAGAAGAAAUUUCCGUUUACCCUCU-5' | (SEQ ID NO: 3379) |
| AAT-919 Target: | 5'-ACATCTTCTTTAAAGGCAAATGGGAGA-3' | (SEQ ID NO: 3394) |
| | 5'-UUAAAGGCAAAUGGGAGAGACCCUU-3' | (SEQ ID NO: 3410) |
| | 3'-GAAAUUUCCGUUUACCCUCUCUGGGAA-5' | (SEQ ID NO: 3380) |
| AAT-926 Target: | 5'-CTTTAAAGGCAAATGGGAGAGACCCTT-3' | (SEQ ID NO: 3395) |
| | 5'-UAAAGGCAAAUGGGAGAGACCCUUU-3' | (SEQ ID NO: 3411) |
| | 3'-AAAUUUCCGUUUACCCUCUCUGGGAAA-5' | (SEQ ID NO: 3381) |
| AAT-927 Target: | 5'-TTTAAAGGCAAATGGGAGAGACCCTTT-3' | (SEQ ID NO: 3396) |
| | 5'-AGAAGCUGUCCAGCUGGGUGCUGCU-3' | (SEQ ID NO: 3412) |
| | 3'-AUUCUUCGACAGGUCGACCCACGACGA-5' | (SEQ ID NO: 3382) |
| AAT-1055 Target: | 5'-TAAGAAGCTGTCCAGCTGGGTGCTGCT-3' | (SEQ ID NO: 3397) |
| | 5'-AUGCCACCGCCAUCUUCUUCCUGCC-3' | (SEQ ID NO: 3413) |
| | 3'-GUUACGGUGGCGGUAGAAGAAGGACGG-5' | (SEQ ID NO: 3383) |
| AAT-1097 Target: | 5'-CAATGCCACCGCCATCTTCTTCCTGCC-3' | (SEQ ID NO: 3398) |
| | 5'-GCCACCGCCAUCUUCUUCCUGCCUG-3' | (SEQ ID NO: 3414) |
| | 3'-UACGGUGGCGGUAGAAGAAGGACGGAC-5' | (SEQ ID NO: 3384) |
| AAT-1099 Target: | 5'-ATGCCACCGCCATCTTCTTCCTGCCTG-3' | (SEQ ID NO: 3399) |
| | 5'-AGGAGGCACCCCUGAAGCUCUCCAA-3' | (SEQ ID NO: 3415) |
| | 3'-UCUCCUCCGUGGGGACUUCGAGAGGUU-5' | (SEQ ID NO: 3385) |
| AAT-1325 Target: | 5'-AGAGGAGGCACCCCTGAAGCTCTCCAA-3' | (SEQ ID NO: 3400) |
| | 5'-AAGGCCGUGCAUAAGGCUGUGCUGA-3' | (SEQ ID NO: 3416) |
| | 3'-GGUUCCGGCACGUAUUCCGACACGACU-5' | (SEQ ID NO: 3386) |
| AAT-1348 Target: | 5'-CCAAGGCCGTGCATAAGGCTGTGCTGA-3' | (SEQ ID NO: 3401) |
| | 5'-CCGUGCAUAAGGCUGUGCUGACCAU-3' | (SEQ ID NO: 3417) |
| | 3'-CCGGCACGUAUUCCGACACGACUGGUA-5' | (SEQ ID NO: 3387) |
| AAT-1352 Target: | 5'-GGCCGTGCATAAGGCTGTGCTGACCAT-3' | (SEQ ID NO: 3402) |

TABLE 19

Other DsiRNA Target Sequences (21mers) in α-1 antitrypsin mRNA

| | | |
|---|---|---|
| AAT-364 21 nt Target: | 5'-AUCCCCAGGGAGAUGCUGCCC-3' | (SEQ ID NO: 3418) |
| AAT-535 21 nt Target: | 5'-CAGCCUUUGCAAUGCUCUCCC-3' | (SEQ ID NO: 3419) |
| AAT-541 21 nt Target: | 5'-UUGCAAUGCUCUCCCUGGGGA-3' | (SEQ ID NO: 3420) |
| AAT-555 21 nt Target: | 5'-CUGGGGACCAAGGCUGACACU-3' | (SEQ ID NO: 3421) |
| AAT-584 21 nt Target: | 5'-AAUCCUGGAGGGCCUGAAUUU-3' | (SEQ ID NO: 3422) |

TABLE 19-continued

Other DsiRNA Target Sequences (21mers) in α-1 antitrypsin mRNA

| | | |
|---|---|---|
| AAT-674 21 nt Target: | 5'-GCCAGACAGCCAGCUCCAGCU-3' | (SEQ ID NO: 3423) |
| AAT-919 21 nt Target: | 5'-ACAUCUUCUUUAAAGGCAAAU-3' | (SEQ ID NO: 3424) |
| AAT-926 21 nt Target: | 5'-CUUUAAAGGCAAAUGGGAGAG-3' | (SEQ ID NO: 3425) |
| AAT-927 21 nt Target: | 5'-UUUAAAGGCAAAUGGGAGAGA-3' | (SEQ ID NO: 3426) |
| AAT-1055 21 nt Target: | 5'-UAAGAAGCUGUCCAGCUGGGU-3' | (SEQ ID NO: 3427) |
| AAT-1097 21 nt Target: | 5'-CAAUGCCACCGCCAUCUUCUU-3' | (SEQ ID NO: 3428) |
| AAT-1099 21 nt Target: | 5'-AUGCCACCGCCAUCUUCUUCC-3' | (SEQ ID NO: 3429) |
| AAT-1325 21 nt Target: | 5'-AGAGGAGGCACCCCUGAAGCU-3' | (SEQ ID NO: 3430) |
| AAT-1348 21 nt Target: | 5'-CCAAGGCCGUGCAUAAGGCUG-3' | (SEQ ID NO: 3431) |
| AAT-1352 21 nt Target: | 5'-GGCCGUGCAUAAGGCUGUGCU-3' | (SEQ ID NO: 3432) |

TABLE 20

Other Human Anti-α-1 antitrypsin "Blunt/Blunt" DsiRNAs

| | | |
|---|---|---|
| | 5'-AUCCCCAGGGAGAUGCUGCCCAGAAGA-3' | (SEQ ID NO: 3433) |
| | 3'-UAGGGGUCCCUCUACGACGGGUCUUCU-5' | (SEQ ID NO: 3373) |
| AAT-364 Target: | 5'-ATCCCCAGGGAGATGCTGCCCAGAAGA-3' | (SEQ ID NO: 3388) |
| | 5'-CAGCCUUUGCAAUGCUCUCCCUGGGGA-3' | (SEQ ID NO: 3434) |
| | 3'-GUCGGAAACGUUACGAGAGGGACCCCU-5' | (SEQ ID NO: 3374) |
| AAT-535 Target: | 5'-CAGCCTTTGCAATGCTCTCCCTGGGGA-3' | (SEQ ID NO: 3389) |
| | 5'-UUGCAAUGCUCUCCCUGGGGACCAAGG-3' | (SEQ ID NO: 3435) |
| | 3'-AACGUUACGAGAGGGACCCCUGGUUCC-5' | (SEQ ID NO: 3375) |
| AAT-541 Target: | 5'-TTGCAATGCTCTCCCTGGGGACCAAGG-3' | (SEQ ID NO: 3390) |
| | 5'-CUGGGGACCAAGGCUGACACUCACGAU-3' | (SEQ ID NO: 3436) |
| | 3'-GACCCCUGGUUCCGACUGUGAGUGCUA-5' | (SEQ ID NO: 3376) |
| AAT-555 Target: | 5'-CTGGGGACCAAGGCTGACACTCACGAT-3' | (SEQ ID NO: 3391) |
| | 5'-AAUCCUGGAGGGCCUGAAUUUCAACCU-3' | (SEQ ID NO: 3437) |
| | 3'-UUAGGACCUCCCGGACUUAAAGUUGGA-5' | (SEQ ID NO: 3377) |
| AAT-584 Target: | 5'-AATCCTGGAGGGCCTGAATTTCAACCT-3' | (SEQ ID NO: 3392) |
| | 5'-GCCAGACAGCCAGCUCCAGCUGACCAC-3' | (SEQ ID NO: 3438) |
| | 3'-CGGUCUGUCGGUCGAGGUCGACUGGUG-5' | (SEQ ID NO: 3378) |
| AAT-674 Target: | 5'-GCCAGACAGCCAGCTCCAGCTGACCAC-3' | (SEQ ID NO: 3393) |
| | 5'-ACAUCUUCUUUAAAGGCAAAUGGGAGA-3' | (SEQ ID NO: 3439) |
| | 3'-UGUAGAAGAAAUUUCCGUUUACCCUCU-5' | (SEQ ID NO: 3379) |
| AAT-919 Target: | 5'-ACATCTTCTTTAAAGGCAAATGGGAGA-3' | (SEQ ID NO: 3394) |
| | 5'-CUUUAAAGGCAAAUGGGAGAGACCCUU-3' | (SEQ ID NO: 3440) |
| | 3'-GAAAUUUCCGUUUACCCUCUCUGGGAA-5' | (SEQ ID NO: 3380) |
| AAT-926 Target: | 5'-CTTTAAAGGCAAATGGGAGAGACCCTT-3' | (SEQ ID NO: 3395) |
| | 5'-UUUAAAGGCAAAUGGGAGAGACCCUUU-3' | (SEQ ID NO: 3441) |
| | 3'-AAAUUUCCGUUUACCCUCUCUGGGAAA-5' | (SEQ ID NO: 3381) |
| AAT-927 Target: | 5'-TTTAAAGGCAAATGGGAGAGACCCTTT-3' | (SEQ ID NO: 3396) |
| | 5'-UAAGAAGCUGUCCAGCUGGGUGCUGCU-3' | (SEQ ID NO: 3442) |
| | 3'-AUUCUUCGACAGGUCGACCCACGACGA-5' | (SEQ ID NO: 3382) |
| AAT-1055 Target: | 5'-TAAGAAGCTGTCCAGCTGGGTGCTGCT-3' | (SEQ ID NO: 3397) |
| | 5'-CAAUGCCACCGCCAUCUUCUUCCUGCC-3' | (SEQ ID NO: 3443) |
| | 3'-GUUACGGUGGCGGUAGAAGAAGGACGG-5' | (SEQ ID NO: 3383) |
| AAT-1097 Target: | 5'-CAATGCCACCGCCATCTTCTTCCTGCC-3' | (SEQ ID NO: 3398) |
| | 5'-AUGCCACCGCCAUCUUCUUCCUGCCUG-3' | (SEQ ID NO: 3444) |
| | 3'-UACGGUGGCGGUAGAAGAAGGACGGAC-5' | (SEQ ID NO: 3384) |
| AAT-1099 Target: | 5'-ATGCCACCGCCATCTTCTTCCTGCCTG-3' | (SEQ ID NO: 3399) |
| | 5'-AGAGGAGGCACCCCUGAAGCUCUCCAA-3' | (SEQ ID NO: 3445) |
| | 3'-UCUCCUCCGUGGGGACUUCGAGAGGUU-5' | (SEQ ID NO: 3385) |
| AAT-1325 Target: | 5'-AGAGGAGGCACCCCTGAAGCTCTCCAA-3' | (SEQ ID NO: 3400) |

TABLE 20-continued

Other Human Anti-α-1 antitrypsin "Blunt/Blunt" DsiRNAs

```
                 5'-CCAAGGCCGUGCAUAAGGCUGUGCUGA-3'    (SEQ ID NO: 3446)
                 3'-GGUUCCGGCACGUAUUCCGACACGACU-5'    (SEQ ID NO: 3386)
AAT-1348 Target: 5'-CCAAGGCCGTGCATAAGGCTGTGCTGA-3'    (SEQ ID NO: 3401)

5'-GGCCGUGCAUAAGGCUGUGCUGACCAU-3'    (SEQ ID NO: 3447)
                 3'-CCGGCACGUAUUCCGACACGACUGGUA-5'    (SEQ ID NO: 3387)
AAT-1352 Target: 5'-GGCCGTGCATAAGGCTGTGCTGACCAT-3'    (SEQ ID NO: 3402)
```

TABLE 21

Other DsiRNA Component 19 Nucleotide Target Sequences in α-1 antitrypsin mRNA

| | | |
|---|---|---|
| AAT-364 19 nt Target #1: | 5'-CCCCAGGGAGAUGCUGCCC-3' | (SEQ ID NO: 3448) |
| AAT-364 19 nt Target #2: | 5'-UCCCCAGGGAGAUGCUGCC-3' | (SEQ ID NO: 3463) |
| AAT-364 19 nt Target #3: | 5'-AUCCCCAGGGAGAUGCUGC-3' | (SEQ ID NO: 3478) |
| AAT-535 19 nt Target #1: | 5'-GCCUUUGCAAUGCUCUCCC-3' | (SEQ ID NO: 3449) |
| AAT-535 19 nt Target #2: | 5'-AGCCUUUGCAAUGCUCUCC-3' | (SEQ ID NO: 3464) |
| AAT-535 19 nt Target #3: | 5'-CAGCCUUUGCAAUGCUCUC-3' | (SEQ ID NO: 3479) |
| AAT-541 19 nt Target #1: | 5'-GCAAUGCUCUCCCUGGGGA-3' | (SEQ ID NO: 3450) |
| AAT-541 19 nt Target #2: | 5'-UGCAAUGCUCUCCCUGGGG-3' | (SEQ ID NO: 3465) |
| AAT-541 19 nt Target #3: | 5'-UUGCAAUGCUCUCCCUGGG-3' | (SEQ ID NO: 3480) |
| AAT-555 19 nt Target #1: | 5'-GGGGACCAAGGCUGACACU-3' | (SEQ ID NO: 3451) |
| AAT-555 19 nt Target #2: | 5'-UGGGGACCAAGGCUGACAC-3' | (SEQ ID NO: 3466) |
| AAT-555 19 nt Target #3: | 5'-CUGGGGACCAAGGCUGACA-3' | (SEQ ID NO: 3481) |
| AAT-584 19 nt Target #1: | 5'-UCCUGGAGGGCCUGAAUUU-3' | (SEQ ID NO: 3452) |
| AAT-584 19 nt Target #2: | 5'-AUCCUGGAGGGCCUGAAUU-3' | (SEQ ID NO: 3467) |
| AAT-584 19 nt Target #3: | 5'-AAUCCUGGAGGGCCUGAAU-3' | (SEQ ID NO: 3482) |
| AAT-674 19 nt Target #1: | 5'-CAGACAGCCAGCUCCAGCU-3' | (SEQ ID NO: 3453) |
| AAT-674 19 nt Target #2: | 5'-CCAGACAGCCAGCUCCAGC-3' | (SEQ ID NO: 3468) |
| AAT-674 19 nt Target #3: | 5'-GCCAGACAGCCAGCUCCAG-3' | (SEQ ID NO: 3483) |
| AAT-919 19 nt Target #1: | 5'-AUCUUCUUUAAAGGCAAAU-3' | (SEQ ID NO: 3454) |
| AAT-919 19 nt Target #2: | 5'-CAUCUUCUUUAAAGGCAAA-3' | (SEQ ID NO: 3469) |
| AAT-919 19 nt Target #3: | 5'-ACAUCUUCUUUAAAGGCAA-3' | (SEQ ID NO: 3484) |
| AAT-926 19 nt Target #1: | 5'-UUAAAGGCAAAUGGGAGAG-3' | (SEQ ID NO: 3455) |
| AAT-926 19 nt Target #2: | 5'-UUUAAAGGCAAAUGGGAGA-3' | (SEQ ID NO: 3470) |
| AAT-926 19 nt Target #3: | 5'-CUUUAAAGGCAAAUGGGAG-3' | (SEQ ID NO: 3485) |
| AAT-927 19 nt Target #1: | 5'-UAAAGGCAAAUGGGAGAGA-3' | (SEQ ID NO: 3456) |
| AAT-927 19 nt Target #2: | 5'-UUAAAGGCAAAUGGGAGAG-3' | (SEQ ID NO: 3471) |
| AAT-927 19 nt Target #3: | 5'-UUUAAAGGCAAAUGGGAGA-3' | (SEQ ID NO: 3486) |
| AAT-1055 19 nt Target #1: | 5'-AGAAGCUGUCCAGCUGGGU-3' | (SEQ ID NO: 3457) |
| AAT-1055 19 nt Target #2: | 5'-AAGAAGCUGUCCAGCUGGG-3' | (SEQ ID NO: 3472) |
| AAT-1055 19 nt Target #3: | 5'-UAAGAAGCUGUCCAGCUGG-3' | (SEQ ID NO: 3487) |
| AAT-1097 19 nt Target #1: | 5'-AUGCCACCGCCAUCUUCUU-3' | (SEQ ID NO: 3458) |

TABLE 21-continued

Other DsiRNA Component 19 Nucleotide Target Sequences
in α-1 antitrypsin mRNA

| | | |
|---|---|---|
| AAT-1097 19 nt Target #2: | 5'-AAUGCCACCGCCAUCUUCU-3' | (SEQ ID NO: 3473) |
| AAT-1097 19 nt Target #3: | 5'-CAAUGCCACCGCCAUCUUC-3' | (SEQ ID NO: 3488) |
| AAT-1099 19 nt Target #1: | 5'-GCCACCGCCAUCUUCUUCC-3' | (SEQ ID NO: 3459) |
| AAT-1099 19 nt Target #2: | 5'-UGCCACCGCCAUCUUCUUC-3' | (SEQ ID NO: 3474) |
| AAT-1099 19 nt Target #3: | 5'-AUGCCACCGCCAUCUUCUU-3' | (SEQ ID NO: 3489) |
| AAT-1325 19 nt Target #1: | 5'-AGGAGGCACCCCUGAAGCU-3' | (SEQ ID NO: 3460) |
| AAT-1325 19 nt Target #2: | 5'-GAGGAGGCACCCCUGAAGC-3' | (SEQ ID NO: 3475) |
| AAT-1325 19 nt Target #3: | 5'-AGAGGAGGCACCCCUGAAG-3' | (SEQ ID NO: 3490) |
| AAT-1348 19 nt Target #1: | 5'-AAGGCCGUGCAUAAGGCUG-3' | (SEQ ID NO: 3461) |
| AAT-1348 19 nt Target #2: | 5'-CAAGGCCGUGCAUAAGGCU-3' | (SEQ ID NO: 3476) |
| AAT-1348 19 nt Target #3: | 5'-CCAAGGCCGUGCAUAAGGC-3' | (SEQ ID NO: 3491) |
| AAT-1352 19 nt Target #1: | 5'-CCGUGCAUAAGGCUGUGCU-3' | (SEQ ID NO: 3462) |
| AAT-1352 19 nt Target #2: | 5'-GCCGUGCAUAAGGCUGUGC-3' | (SEQ ID NO: 3477) |
| AAT-1352 19 nt Target #3: | 5'-GGCCGUGCAUAAGGCUGUG-3' | (SEQ ID NO: 3492) |

Within Tables 2, 3, 5, 7, 8, 10, 12, 13, 15, 17, 18 and 20 above, underlined residues indicate 2'-O-methyl residues, UPPER CASE indicates ribonucleotides, and lower case denotes deoxyribonucleotides. The DsiRNA agents of Tables 2-3, 7-8, 12-13 and 17-18 above are 25/27mer agents possessing a blunt end. The structures and/or modification patterning of the agents of Tables 2-3, 7-8, 12-13 and 17-18 above can be readily adapted to the above generic sequence structures, e.g., the 3' overhang of the second strand can be extended or contracted, 2'-O-methylation of the second strand can be expanded towards the 5' end of the second strand, optionally at alternating sites, etc. Such further modifications are optional, as 25/27mer DsiRNAs with such modifications can also be readily designed from the above DsiRNA agents and are also expected to be functional inhibitors of α-1 antitrypsin expression. Similarly, the 27mer "blunt/blunt" DsiRNA structures and/or modification patterns of the agents of Tables 5, 10, 15 and 20 above can also be readily adapted to the above generic sequence structures, e.g., for application of modification patterning of the antisense strand to such structures and/or adaptation of such sequences to the above generic structures.

In certain embodiments, 27mer DsiRNAs possessing independent strand lengths each of 27 nucleotides are designed and synthesized for targeting of the same sites within the α-1 antitrypsin transcript as the asymmetric "25/27" structures shown in Tables 2-3, 7-8, 12-13 and 17-18 herein. Exemplary "27/27" DsiRNAs are optionally designed with a "blunt/blunt" structure as shown for the DsiRNAs of Tables 5, 10, 15 and 20 above.

In certain embodiments, the dsRNA agents of the invention require, e.g., at least 19, at least 20, at least 21, at least 22, at least 23, at least 24, at least 25 or at least 26 residues of the first strand to be complementary to corresponding residues of the second strand. In certain related embodiments, these first strand residues complementary to corresponding residues of the second strand are optionally consecutive residues.

In certain DsiRNAmm ("DsiRNA mismatch") embodiments of the instant invention, mismatched base pairs are located within a "mismatch-tolerant region" which is defined herein with respect to the location of the projected Ago2 cut site of the corresponding target nucleic acid. The mismatch tolerant region is located "upstream of" the projected Ago2 cut site of the target strand. "Upstream" in this context will be understood as the 5'-most portion of the DsiRNAmm duplex, where 5' refers to the orientation of the sense strand of the DsiRNA duplex. Therefore, the mismatch tolerant region is upstream of the base on the sense (passenger) strand that corresponds to the projected Ago2 cut site of the target nucleic acid (see FIG. 1); alternatively, when referring to the antisense (guide) strand of the DsiRNAmm, the mismatch tolerant region can also be described as positioned downstream of the base that is complementary to the projected Ago2 cut site of the target nucleic acid, that is, the 3'-most portion of the antisense strand of the DsiRNAmm (where position 1 of the antisense strand is the 5' terminal nucleotide of the antisense strand, see FIG. 1).

In one embodiment, for example with numbering as depicted in FIG. 1, the mismatch tolerant region is positioned between and including base pairs 3-9 when numbered from the nucleotide starting at the 5' end of the sense strand of the duplex. Therefore, a DsiRNAmm of the invention possesses a single mismatched base pair at any one of positions 3, 4, 5, 6, 7, 8 or 9 of the sense strand of a right-hand extended DsiRNA (where position 1 is the 5' terminal nucleotide of the sense strand and position 9 is the nucleotide residue of the sense strand that is immediately 5' of the projected Ago2 cut site of the target α-1 antitrypsin RNA sequence corresponding to the sense strand sequence). In certain embodiments, for a DsiRNAmm that possesses a mismatched base pair nucleotide at any of positions 3, 4, 5, 6, 7, 8 or 9 of the sense strand, the corresponding mismatched base pair nucleotide of the antisense strand not only forms a mismatched base pair with the DsiRNAmm sense strand sequence, but also forms a mismatched base pair with a DsiRNAmm target α-1 antitrypsin RNA sequence (thus, complementarity between the antisense strand sequence and the sense strand sequence is disrupted at the mismatched base pair within the DsiRNAmm, and complementarity is similarly disrupted between the antisense strand sequence of the DsiRNAmm and the target α-1 antitrypsin RNA sequence). In alternative embodiments, the mismatch base pair nucleotide of the antisense strand of a DsiRNAmm only form a mismatched base pair with a corresponding nucleotide of the sense strand sequence of the DsiRNAmm, yet base pairs with its corresponding target α-1 antitrypsin RNA sequence nucleotide (thus, complementarity between the antisense strand sequence and the sense strand sequence is disrupted at the mismatched base pair within the DsiRNAmm, yet complementarity is maintained between the antisense strand sequence of the DsiRNAmm and the target α-1 antitrypsin RNA sequence).

A DsiRNAmm of the invention that possesses a single mismatched base pair within the mismatch-tolerant region (mismatch region) as described above (e.g., a DsiRNAmm harboring a mismatched nucleotide residue at any one of positions 3, 4, 5, 6, 7, 8 or 9 of the sense strand) can further include one, two or even three additional mismatched base pairs. In preferred embodiments, these one, two or three additional mismatched base pairs of the DsiRNAmm occur at position(s) 3, 4, 5, 6, 7, 8 and/or 9 of the sense strand (and at corresponding residues of the antisense strand). In one embodiment where one additional mismatched base pair is present within a DsiRNAmm, the two mismatched base pairs of the sense strand can occur, e.g., at nucleotides of both position 4 and position 6 of the sense strand (with mismatch also occurring at corresponding nucleotide residues of the antisense strand).

In DsiRNAmm agents possessing two mismatched base pairs, mismatches can occur consecutively (e.g., at consecutive positions along the sense strand nucleotide sequence). Alternatively, nucleotides of the sense strand that form mismatched base pairs with the antisense strand sequence can be interspersed by nucleotides that base pair with the antisense strand sequence (e.g., for a DsiRNAmm possessing mismatched nucleotides at positions 3 and 6, but not at positions 4 and 5, the mismatched residues of sense strand positions 3 and 6 are interspersed by two nucleotides that form matched base pairs with corresponding residues of the antisense strand). For example, two residues of the sense strand (located within the mismatch-tolerant region of the sense strand) that form mismatched base pairs with the corresponding antisense strand sequence can occur with zero, one, two, three, four or five matched base pairs located between these mismatched base pairs.

For certain DsiRNAmm agents possessing three mismatched base pairs, mismatches can occur consecutively (e.g., in a triplet along the sense strand nucleotide sequence). Alternatively, nucleotides of the sense strand that form mismatched base pairs with the antisense strand sequence can be interspersed by nucleotides that form matched base pairs with the antisense strand sequence (e.g., for a DsiRNAmm possessing mismatched nucleotides at positions 3, 4 and 8, but not at positions 5, 6 and 7, the mismatched residues of sense strand positions 3 and 4 are adjacent to one another, while the mismatched residues of sense strand positions 4 and 8 are interspersed by three nucleotides that form matched base pairs with corresponding residues of the antisense strand). For example, three residues of the sense strand (located within the mismatch-tolerant region of the sense strand) that form mismatched base pairs with the corresponding antisense strand sequence can occur with zero, one, two, three or four matched base pairs located between any two of these mismatched base pairs.

For certain DsiRNAmm agents possessing four mismatched base pairs, mismatches can occur consecutively (e.g., in a quadruplet along the sense strand nucleotide sequence). Alternatively, nucleotides of the sense strand that form mismatched base pairs with the antisense strand sequence can be interspersed by nucleotides that form matched base pairs with the antisense strand sequence (e.g., for a DsiRNAmm possessing mismatched nucleotides at positions 3, 5, 7 and 8, but not at positions 4 and 6, the mismatched residues of sense strand positions 7 and 8 are adjacent to one another, while the mismatched residues of sense strand positions 3 and 5 are interspersed by one nucleotide that forms a matched base pair with the corresponding residue of the antisense strand—similarly, the mismatched residues of sense strand positions 5 and 7 are also interspersed by one nucleotide that forms a matched base pair with the corresponding residue of the antisense strand). For example, four residues of the sense strand (located within the mismatch-tolerant region of the sense strand) that form mismatched base pairs with the corresponding antisense strand sequence can occur with zero, one, two or three matched base pairs located between any two of these mismatched base pairs.

In another embodiment, for example with numbering also as depicted in FIG. 1, a DsiRNAmm of the invention comprises a mismatch tolerant region which possesses a single mismatched base pair nucleotide at any one of positions 17, 18, 19, 20, 21, 22 or 23 of the antisense strand of the DsiRNA (where position 1 is the 5' terminal nucleotide of the antisense strand and position 17 is the nucleotide residue of the antisense strand that is immediately 3' (downstream) in the antisense strand of the projected Ago2 cut site of the target α-1 antitrypsin RNA sequence sufficiently complementary to the antisense strand sequence). In certain embodiments, for a DsiRNAmm that possesses a mismatched base pair nucleotide at any of positions 17, 18, 19, 20, 21, 22 or 23 of the antisense strand with respect to the sense strand of the DsiRNAmm, the mismatched base pair nucleotide of the antisense strand not only forms a mismatched base pair with the DsiRNAmm sense strand sequence, but also forms a mismatched base pair with a DsiRNAmm target α-1 antitrypsin RNA sequence (thus, complementarity between the antisense strand sequence and the sense strand sequence is disrupted at the mismatched base pair within the DsiRNAmm, and complementarity is similarly disrupted between the antisense strand sequence of the DsiRNAmm and the target α-1 antitrypsin RNA sequence). In alternative embodiments, the mismatch base pair nucleotide of the antisense strand of a DsiRNAmm only forms a mismatched base pair with a corresponding nucleotide of the sense strand sequence of the DsiRNAmm, yet base pairs with its corresponding target α-1 antitrypsin RNA sequence nucleotide (thus, complementarity between the antisense strand sequence and the sense strand sequence is disrupted at the mismatched base pair within the DsiRNAmm, yet complementarity is maintained between the antisense strand sequence of the DsiRNAmm and the target α-1 antitrypsin RNA sequence).

A DsiRNAmm of the invention that possesses a single mismatched base pair within the mismatch-tolerant region as described above (e.g., a DsiRNAmm harboring a mismatched nucleotide residue at positions 17, 18, 19, 20, 21, 22 or 23 of the antisense strand) can further include one, two or even three additional mismatched base pairs. In preferred embodiments, these one, two or three additional mismatched base pairs of the DsiRNAmm occur at position(s) 17, 18, 19, 20, 21, 22 and/or 23 of the antisense strand (and at corresponding residues of the sense strand). In one embodiment where one additional mismatched base pair is present within a DsiRNAmm, the two mismatched base pairs of the antisense strand can occur, e.g., at nucleotides of both position 18 and position 20 of the antisense strand (with mismatch also occurring at corresponding nucleotide residues of the sense strand).

In DsiRNAmm agents possessing two mismatched base pairs, mismatches can occur consecutively (e.g., at consecutive positions along the antisense strand nucleotide sequence). Alternatively, nucleotides of the antisense strand that form mismatched base pairs with the sense strand sequence can be interspersed by nucleotides that base pair with the sense strand sequence (e.g., for a DsiRNAmm possessing mismatched nucleotides at positions 17 and 20, but not at positions 18 and 19, the mismatched residues of antisense strand positions 17 and 20 are interspersed by two nucleotides that form matched base pairs with corresponding residues of the sense strand). For example, two residues of the antisense strand (located within the mismatch-tolerant region of the sense strand) that form mismatched base pairs with the corresponding sense strand sequence can occur with zero, one, two, three, four, five, six or seven matched base pairs located between these mismatched base pairs.

For certain DsiRNAmm agents possessing three mismatched base pairs, mismatches can occur consecutively (e.g., in a triplet along the antisense strand nucleotide sequence). Alternatively, nucleotides of the antisense strand that form mismatched base pairs with the sense strand sequence can be interspersed by nucleotides that form matched base pairs with the sense strand sequence (e.g., for a DsiRNAmm possessing mismatched nucleotides at positions 17, 18 and 22, but not at positions 19, 20 and 21, the mismatched residues of antisense strand positions 17 and 18 are adjacent to one another, while the mismatched residues of antisense strand positions 18 and 122 are interspersed by three nucleotides that form matched base pairs with corresponding residues of the sense strand). For example, three residues of the antisense strand (located within the mismatch-tolerant region of the antisense strand) that form mismatched base pairs with the corresponding sense strand sequence can occur with zero, one, two, three, four, five or six matched base pairs located between any two of these mismatched base pairs.

For certain DsiRNAmm agents possessing four mismatched base pairs, mismatches can occur consecutively (e.g., in a quadruplet along the antisense strand nucleotide sequence). Alternatively, nucleotides of the antisense strand that form mismatched base pairs with the sense strand sequence can be interspersed by nucleotides that form matched base pairs with the sense strand sequence (e.g., for a DsiRNAmm possessing mismatched nucleotides at positions 18, 20, 22 and 23, but not at positions 19 and 21, the mismatched residues of antisense strand positions 22 and 23 are adjacent to one another, while the mismatched residues of antisense strand positions 18 and 20 are interspersed by one nucleotide that forms a matched base pair with the corresponding residue of the sense strand—similarly, the mismatched residues of antisense strand positions 20 and 22 are also interspersed by one nucleotide that forms a matched base pair with the corresponding residue of the sense strand). For example, four residues of the antisense strand (located within the mismatch-tolerant region of the antisense strand) that form mismatched base pairs with the corresponding sense strand sequence can occur with zero, one, two, three, four or five matched base pairs located between any two of these mismatched base pairs.

For reasons of clarity, the location(s) of mismatched nucleotide residues within the above DsiRNAmm agents are numbered in reference to the 5' terminal residue of either sense or antisense strands of the DsiRNAmm. The numbering of positions located within the mismatch-tolerant region (mismatch region) of the antisense strand can shift with variations in the proximity of the 5' terminus of the sense or antisense strand to the projected Ago2 cleavage site. Thus, the location(s) of preferred mismatch sites within either antisense strand or sense strand can also be identified as the permissible proximity of such mismatches to the projected Ago2 cut site. Accordingly, in one preferred embodiment, the position of a mismatch nucleotide of the sense strand of a DsiRNAmm is the nucleotide residue of the sense strand that is located immediately 5' (upstream) of the projected Ago2 cleavage site of the corresponding target α-1 antitrypsin RNA sequence. In other preferred embodiments, a mismatch nucleotide of the sense strand of a DsiRNAmm is positioned at the nucleotide residue of the sense strand that is located two nucleotides 5' (upstream) of the projected Ago2 cleavage site, three nucleotides 5' (upstream) of the projected Ago2 cleavage site, four nucleotides 5' (upstream) of the projected Ago2 cleavage site, five nucleotides 5' (upstream) of the projected Ago2 cleavage site, six nucleotides 5' (upstream) of the projected Ago2 cleavage site, seven nucleotides 5' (upstream) of the projected Ago2 cleavage site, eight nucleotides 5' (upstream) of the projected Ago2 cleavage site, or nine nucleotides 5' (upstream) of the projected Ago2 cleavage site.

Exemplary single mismatch-containing 25/27mer DsiRNAs (DsiRNAmm) include the following structures (such mismatch-containing structures may also be incorporated into other exemplary DsiRNA structures shown herein).

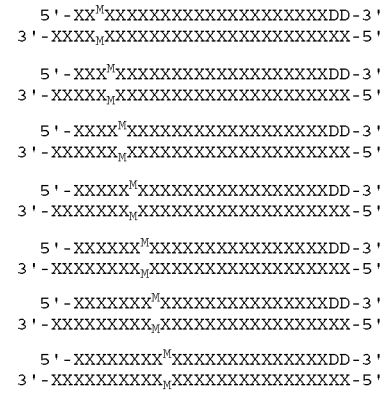

wherein "X"=RNA, "D"=DNA and "M"=Nucleic acid residues (RNA, DNA or non-natural or modified nucleic acids) that do not base pair (hydrogen bond) with corresponding "M" residues of otherwise complementary strand when strands are annealed. Any of the residues of such agents can optionally be 2'-O-methyl RNA monomers—alternating positioning of 2'-O-methyl RNA monomers that commences from the 3'-terminal residue of the bottom (second) strand, as shown above, can also be used in the above DsiRNAmm agents. For the above mismatch structures, the top strand is the sense strand, and the bottom strand is the antisense strand.

In certain embodiments, a DsiRNA of the invention can contain mismatches that exist in reference to the target α-1 antitrypsin RNA sequence yet do not necessarily exist as mismatched base pairs within the two strands of the DsiRNA—thus, a DsiRNA can possess perfect complementarity between first and second strands of a DsiRNA, yet still possess mismatched residues in reference to a target α-1 antitrypsin RNA (which, in certain embodiments, may be advantageous in promoting efficacy and/or potency and/or duration of effect). In certain embodiments, where mismatches occur between antisense strand and target α-1 antitrypsin RNA sequence, the position of a mismatch is located within the antisense strand at a position(s) that corresponds to a sequence of the sense strand located 5' of the projected Ago2 cut site of the target region—e.g., antisense strand residue(s) positioned within the antisense strand to the 3' of the antisense residue which is complementary to the projected Ago2 cut site of the target sequence.

Exemplary 25/27mer DsiRNAs that harbor a single mismatched residue in reference to target sequences include the following structures.

RNA monomers—alternating positioning of 2'-O-methyl RNA monomers that commences from the 3'-terminal residue of the bottom (second) strand, as shown above, can also be used in the above DsiRNA agents.

In certain embodiments, the guide strand of a dsRNA of the invention that is sufficiently complementary to a target RNA (e.g., mRNA) along at least 19 nucleotides of the target gene sequence to reduce target gene expression is not perfectly complementary to the at least 19 nucleotide long target gene sequence. Rather, it is appreciated that the guide strand of a dsRNA of the invention that is sufficiently complementary to a target mRNA along at least 19 nucleotides of a target RNA sequence to reduce target gene expression can have one, two, three, or even four or more nucleotides that are mismatched with the 19 nucleotide or longer target strand sequence. Thus, for a 19 nucleotide target RNA sequence, the guide strand of a dsRNA of the invention can be sufficiently complementary to the target RNA sequence to reduce target gene levels while possessing, e.g., only 15/19, 16/19, 17/19 or 18/19 matched nucleotide residues between guide strand and target RNA sequence.

```
Target RNA Sequence:      5'-...AXXXXXXXXXXXXXXXXXXXX....-3'
DsiRNAmm Sense Strand:    5'-XXXXXXXXXXXXXXXXXXXXXXXXXDD-3'
DsiRNAmm Antisense Strand: 3'-EXXXXXXXXXXXXXXXXXXXXXXXXXX-5'

Target RNA Sequence:      5'-...XAXXXXXXXXXXXXXXXXXXX....-3'
DsiRNAmm Sense Strand:    5'-XXXXXXXXXXXXXXXXXXXXXXXXXDD-3'
DsiRNAmm Antisense Strand: 3'-XEXXXXXXXXXXXXXXXXXXXXXXXXX-5'

Target RNA Sequence:      5'-...AXXXXXXXXXXXXXXXXXXX....-3'
DsiRNAmm Sense Strand:    5'-BXXXXXXXXXXXXXXXXXXXXXXXXDD-3'
DsiRNAmm Antisense Strand: 3'-XXEXXXXXXXXXXXXXXXXXXXXXXXX-5'

Target RNA Sequence:      5'-...XAXXXXXXXXXXXXXXXXXX....-3'
DsiRNAmm Sense Strand:    5'-XBXXXXXXXXXXXXXXXXXXXXXXXDD-3'
DsiRNAmm Antisense Strand: 3'-XXXEXXXXXXXXXXXXXXXXXXXXXXX-5'

Target RNA Sequence:      5'-...XXAXXXXXXXXXXXXXXXXX....-3'
DsiRNAmm Sense Strand:    5'-XXBXXXXXXXXXXXXXXXXXXXXXXDD-3'
DsiRNAmm Antisense Strand: 3'-XXXXEXXXXXXXXXXXXXXXXXXXXXX-5'

Target RNA Sequence:      5'-...XXXAXXXXXXXXXXXXXXXX....-3'
DsiRNAmm Sense Strand:    5'-XXXBXXXXXXXXXXXXXXXXXXXXXDD-3'
DsiRNAmm Antisense Strand: 3'-XXXXXEXXXXXXXXXXXXXXXXXXXXX-5'

Target RNA Sequence:      5'-...XXXXAXXXXXXXXXXXXXXX....-3'
DsiRNAmm Sense Strand:    5'-XXXXBXXXXXXXXXXXXXXXXXXXXDD-3'
DsiRNAmm Antisense Strand: 3'-XXXXXXEXXXXXXXXXXXXXXXXXXXX-5'

Target RNA Sequence:      5'-...XXXXXAXXXXXXXXXXXXXX....-3'
DsiRNAmm Sense Strand:    5'-XXXXXBXXXXXXXXXXXXXXXXXXXDD-3'
DsiRNAmm Antisense Strand: 3'-XXXXXXXEXXXXXXXXXXXXXXXXXXX-5'

Target RNA Sequence:      5'-...XXXXXXAXXXXXXXXXXXXX....-3'
DsiRNAmm Sense Strand:    5'-XXXXXXBXXXXXXXXXXXXXXXXXXDD-3'
DsiRNAmm Antisense Strand: 3'-XXXXXXXXEXXXXXXXXXXXXXXXXXX-5'

Target RNA Sequence:      5'-...XXXXXXXAXXXXXXXXXXXX....-3'
DsiRNAmm Sense Strand:    5'-XXXXXXXBXXXXXXXXXXXXXXXXXDD-3'
DsiRNAmm Antisense Strand: 3'-XXXXXXXXXEXXXXXXXXXXXXXXXXX-5'

Target RNA Sequence:      5'-...XXXXXXXXAXXXXXXXXXXX....-3'
DsiRNAmm Sense Strand:    5'-XXXXXXXXBXXXXXXXXXXXXXXXXDD-3'
DsiRNAmm Antisense Strand: 3'-XXXXXXXXXXEXXXXXXXXXXXXXXXX-5'
``` wherein "X"=RNA, "D"=DNA and "E"=Nucleic acid residues (RNA, DNA or non-natural or modified nucleic acids) that do not base pair (hydrogen bond) with corresponding "A" RNA residues of otherwise complementary (target) strand when strands are annealed, yet optionally do base pair with corresponding "B" residues ("B" residues are also RNA, DNA or non-natural or modified nucleic acids). Any of the residues of such agents can optionally be 2'-O-methyl In addition to the above-exemplified structures, dsRNAs of the invention can also possess one, two or three additional residues that form further mismatches with the target α-1 antitrypsin RNA sequence. Such mismatches can be consecutive, or can be interspersed by nucleotides that form matched base pairs with the target α-1 antitrypsin RNA sequence. Where interspersed by nucleotides that form matched base pairs, mismatched residues can be spaced apart from each other within a single strand at an interval of one, two, three, four, five, six, seven or even eight base paired nucleotides between such mismatch-forming residues.

As for the above-described DsiRNAmm agents, a preferred location within dsRNAs (e.g., DsiRNAs) for antisense strand nucleotides that form mismatched base pairs with target α-1 antitrypsin RNA sequence (yet may or may not form mismatches with corresponding sense strand nucleotides) is within the antisense strand region that is located 3' (downstream) of the antisense strand sequence which is complementary to the projected Ago2 cut site of the DsiRNA (e.g., in FIG. 1, the region of the antisense strand which is 3' of the projected Ago2 cut site is preferred for mismatch-forming residues and happens to be located at positions 17-23 of the antisense strand for the 25/27mer agent shown in FIG. 1). Thus, in one embodiment, the position of a mismatch nucleotide (in relation to the target α-1 antitrypsin RNA sequence) of the antisense strand of a DsiRNAmm is the nucleotide residue of the antisense strand that is located immediately 3' (downstream) within the antisense strand sequence of the projected Ago2 cleavage site of the corresponding target α-1 antitrypsin RNA sequence. In other preferred embodiments, a mismatch nucleotide of the antisense strand of a DsiRNAmm (in relation to the target α-1 antitrypsin RNA sequence) is positioned at the nucleotide residue of the antisense strand that is located two nucleotides 3' (downstream) of the corresponding projected Ago2 cleavage site, three nucleotides 3' (downstream) of the corresponding projected Ago2 cleavage site, four nucleotides 3' (downstream) of the corresponding projected Ago2 cleavage site, five nucleotides 3' (downstream) of the corresponding projected Ago2 cleavage site, six nucleotides 3' (downstream) of the projected Ago2 cleavage site, seven nucleotides 3' (downstream) of the projected Ago2 cleavage site, eight nucleotides 3' (downstream) of the projected Ago2 cleavage site, or nine nucleotides 3' (downstream) of the projected Ago2 cleavage site.

In dsRNA agents possessing two mismatch-forming nucleotides of the antisense strand (where mismatch-forming nucleotides are mismatch forming in relation to target α-1 antitrypsin RNA sequence), mismatches can occur consecutively (e.g., at consecutive positions along the antisense strand nucleotide sequence). Alternatively, nucleotides of the antisense strand that form mismatched base pairs with the target α-1 antitrypsin RNA sequence can be interspersed by nucleotides that base pair with the target α-1 antitrypsin RNA sequence (e.g., for a DsiRNA possessing mismatch-forming nucleotides at positions 17 and 20 (starting from the 5' terminus (position 1) of the antisense strand of the 25/27mer agent shown in FIG. 1), but not at positions 18 and 19, the mismatched residues of sense strand positions 17 and 20 are interspersed by two nucleotides that form matched base pairs with corresponding residues of the target α-1 antitrypsin RNA sequence). For example, two residues of the antisense strand (located within the mismatch-tolerant region of the antisense strand) that form mismatched base pairs with the corresponding target α-1 antitrypsin RNA sequence can occur with zero, one, two, three, four or five matched base pairs (with respect to target α-1 antitrypsin RNA sequence) located between these mismatch-forming base pairs.

For certain dsRNAs possessing three mismatch-forming base pairs (mismatch-forming with respect to target α-1 antitrypsin RNA sequence), mismatch-forming nucleotides can occur consecutively (e.g., in a triplet along the antisense strand nucleotide sequence). Alternatively, nucleotides of the antisense strand that form mismatched base pairs with the target α-1 antitrypsin RNA sequence can be interspersed by nucleotides that form matched base pairs with the target α-1 antitrypsin RNA sequence (e.g., for a DsiRNA possessing mismatched nucleotides at positions 17, 18 and 22, but not at positions 19, 20 and 21, the mismatch-forming residues of antisense strand positions 17 and 18 are adjacent to one another, while the mismatch-forming residues of antisense strand positions 18 and 22 are interspersed by three nucleotides that form matched base pairs with corresponding residues of the target α-1 antitrypsin RNA). For example, three residues of the antisense strand (located within the mismatch-tolerant region of the antisense strand) that form mismatched base pairs with the corresponding target α-1 antitrypsin RNA sequence can occur with zero, one, two, three or four matched base pairs located between any two of these mismatch-forming base pairs.

For certain dsRNAs possessing four mismatch-forming base pairs (mismatch-forming with respect to target α-1 antitrypsin RNA sequence), mismatch-forming nucleotides can occur consecutively (e.g., in a quadruplet along the sense strand nucleotide sequence). Alternatively, nucleotides of the antisense strand that form mismatched base pairs with the target α-1 antitrypsin RNA sequence can be interspersed by nucleotides that form matched base pairs with the target α-1 antitrypsin RNA sequence (e.g., for a DsiRNA possessing mismatch-forming nucleotides at positions 17, 19, 21 and 22, but not at positions 18 and 20, the mismatch-forming residues of antisense strand positions 21 and 22 are adjacent to one another, while the mismatch-forming residues of antisense strand positions 17 and 19 are interspersed by one nucleotide that forms a matched base pair with the corresponding residue of the target α-1 antitrypsin RNA sequence—similarly, the mismatch-forming residues of antisense strand positions 19 and 21 are also interspersed by one nucleotide that forms a matched base pair with the corresponding residue of the target α-1 antitrypsin RNA sequence). For example, four residues of the antisense strand (located within the mismatch-tolerant region of the antisense strand) that form mismatched base pairs with the corresponding target α-1 antitrypsin RNA sequence can occur with zero, one, two or three matched base pairs located between any two of these mismatch-forming base pairs.

The above DsiRNAmm and other dsRNA structures are described in order to exemplify certain structures of DsiRNAmm and dsRNA agents. Design of the above DsiRNAmm and dsRNA structures can be adapted to generate, e.g., DsiRNAmm forms of other DsiRNA structures shown infra. As exemplified above, dsRNAs can also be designed that possess single mismatches (or two, three or four mismatches) between the antisense strand of the dsRNA and a target sequence, yet optionally can retain perfect complementarity between sense and antisense strand sequences of a dsRNA.

It is further noted that the dsRNA agents exemplified infra can also possess insertion/deletion (in/del) structures within their double-stranded and/or target α-1 antitrypsin RNA-aligned structures. Accordingly, the dsRNAs of the invention can be designed to possess in/del variations in, e.g., antisense strand sequence as compared to target α-1 antitrypsin RNA sequence and/or antisense strand sequence as compared to sense strand sequence, with preferred location(s) for placement of such in/del nucleotides corresponding to those locations described above for positioning of mismatched and/or mismatch-forming base pairs.

It is also noted that the DsiRNAs of the instant invention can tolerate mismatches within the 3'-terminal region of the sense strand/5'-terminal region of the antisense strand, as this region is modeled to be processed by Dicer and liberated from the guide strand sequence that loads into RISC. Exemplary DsiRNA structures of the invention that harbor such mismatches include the following:

```
Target RNA Sequence:      5'-...XXXXXXXXXXXXXXXXXXXXXHXXX...-3'
DsiRNA Sense Strand:      5'-XXXXXXXXXXXXXXXXXXXXXIXDD-3'
DsiRNA Antisense Strand:  3'-XXXXXXXXXXXXXXXXXXXXXXJXXX-5'

Target RNA Sequence:      5'-...XXXXXXXXXXXXXXXXXXXXXXHXX...-3'
DsiRNA Sense Strand:      5'-XXXXXXXXXXXXXXXXXXXXXXIDD-3'
DsiRNA Antisense Strand:  3'-XXXXXXXXXXXXXXXXXXXXXXXJXX-5'

Target RNA Sequence:      5'-...XXXXXXXXXXXXXXXXXXXXXXXHX...-3'
DsiRNA Sense Strand:      5'-XXXXXXXXXXXXXXXXXXXXXXXID-3'
DsiRNA Antisense Strand:  3'-XXXXXXXXXXXXXXXXXXXXXXXXJX-5'

Target RNA Sequence:      5'-...XXXXXXXXXXXXXXXXXXXXXXXXH...-3'
DsiRNA Sense Strand:      5'-XXXXXXXXXXXXXXXXXXXXXXXXDI-3'
DsiRNA Antisense Strand:  3'-XXXXXXXXXXXXXXXXXXXXXXXXXJ-5'
``` wherein "X"=RNA, "D"=DNA and "I" and "J"=Nucleic acid residues (RNA, DNA or non-natural or modified nucleic acids) that do not base pair (hydrogen bond) with one another, yet optionally "J" is complementary to target RNA sequence nucleotide "H". Any of the residues of such agents can optionally be 2'-O-methyl RNA monomers—alternating positioning of 2'-O-methyl RNA monomers that commences from the 3'-terminal residue of the bottom (second) strand, as shown above—or any of the above-described methylation patterns—can also be used in the above DsiRNA agents. The above mismatches can also be combined within the DsiRNAs of the instant invention.

In the below exemplary structures, such mismatches are introduced within the asymmetric AAT-506 DsiRNA (newly-introduced mismatch residues are italicized):

AAT-506 25/27mer DsiRNA, mismatch position=19 of sense strand (from 5'-terminus)

```
5'-UCUUCUUCUCCCCAGUGA^ACAUCgc-3'    (SEQ ID NO: 3326)
3'-AUAGAAGAAGAGGGGUCACU_CGUAGCG-5'  (SEQ ID NO: 213)
```

Optionally, the mismatched 'A' residue of position 19 of the sense strand is alternatively 'U' or 'C'.
AAT-506 25/27mer DsiRNA, mismatch position=20 of sense strand (from 5'-terminus)

```
5'-UCUUCUUCUCCCCAGUGAG^UAUCgc-3'    (SEQ ID NO: 3327)
3'-AUAGAAGAAGAGGGGUCACUC_GUAGCG-5'  (SEQ ID NO: 213)
```

Optionally, the mismatched 'U' residue of position 20 of the sense strand is alternatively 'A' or 'G'.
AAT-506 25/27mer DsiRNA, mismatch position=21 of sense strand (from 5'-terminus)

```
5'-UCUUCUUCUCCCCAGUGAGC^UUCgc-3'    (SEQ ID NO: 3328)
3'-AUAGAAGAAGAGGGGUCACUCG_UAGCG-5'  (SEQ ID NO: 213)
```

Optionally, the mismatched 'U' residue of position 21 of the sense strand is alternatively 'G' or 'C'.
AAT-506 25/27mer DsiRNA, mismatch position=22 of sense strand (from 5'-terminus)

```
5'-UCUCUUCUCCCCAGUGAGCA^GCgc-3'     (SEQ ID NO: 3329)
3'-AUAGAAGAAGAGGGGUCACUCGU_AGCG-5'  (SEQ ID NO: 213)
```

Optionally, the mismatched 'G' residue of position 22 of the sense strand is alternatively 'A' or 'C'.
AAT-506 25/27mer DsiRNA, mismatch position=23 of sense strand (from 5'-terminus)

```
5'-UCUUCUUCUCCCCAGUGAGCAU^Agc-3'    (SEQ ID NO: 3330)
3'-AUAGAAGAAGAGGGGUCACUCGUA_GCG-5'  (SEQ ID NO: 213)
```

Optionally, the mismatched 'A' residue of position 23 of the sense strand is alternatively 'U' or 'G'.
AAT-506 25/27mer DsiRNA, mismatch position=24 of sense strand (from 5'-terminus)

```
5'-UCUUCUUCUCCCCAGUGAGCAUC^tc-3'    (SEQ ID NO: 3331)
3'-AUAGAAGAAGAGGGGUCACUCGUAG_CG-5'  (SEQ ID NO: 213)
```

Optionally, the mismatched 't' residue of position 24 of the sense strand is alternatively 'a' or 'c'.
AAT-506 25/27mer DsiRNA, mismatch position=25 of sense strand (from 5'-terminus)

```
5'-UCUUCUUCUCCCCAGUGAGCAUCg^a-3'    (SEQ ID NO: 3332)
3'-AUAGAAGAAGAGGGGUCACUCGUAGC_G-5'  (SEQ ID NO: 213)
```

Optionally, the mismatched 'a' residue of position 25 of the sense strand is alternatively 't' or 'g'.
AAT-506 25/27mer DsiRNA, mismatch position=1 of antisense strand (from 5'-terminus)

```
5'-UCUUCUUCUCCCCAGUGAGCAUCg^c-3'    (SEQ ID NO: 15)
3'-AUAGAAGAAGAGGGGUCACUCGUAGC_U-5'  (SEQ ID NO: 3333)
```

Optionally, the mismatched 'U' residue of position 1 of the antisense strand is alternatively 'A' or 'C'.
AAT-506 25/27mer DsiRNA, mismatch position=2 of antisense strand (from 5'-terminus)

```
5'-UCUUCUUCUCCCCAGUGAGCAUC^gc-3'    (SEQ ID NO: 15)
3'-AUAGAAGAAGAGGGGUCACUCGUAG_AG-5'  (SEQ ID NO: 3334)
```

Optionally, the mismatched 'A' residue of position 2 of the antisense strand is alternatively 'U' or 'G'.
AAT-506 25/27mer DsiRNA, mismatch position=3 of antisense strand (from 5'-terminus)

```
5'-UCUUCUUCUCCCCAGUGAGCAU^Cgc-3'      (SEQ ID NO: 15)
3'-AUAGAAGAAGAGGGGUCACUCGUA_UCG-5'    (SEQ ID NO: 3335)
```

Optionally, the mismatched 'U' residue of position 3 of the antisense strand is alternatively 'A' or 'C'.
AAT-506 25/27mer DsiRNA, mismatch position=4 of antisense strand (from 5'-terminus)

```
5'-UCUUCUUCUCCCCAGUGAGCA^Ucgc-3'      (SEQ ID NO: 15)
3'-AUAGAAGAAGAGGGGUCACUCGU_CGCG-5'    (SEQ ID NO: 3336)
```

Optionally, the mismatched 'C' residue of position 4 of the antisense strand is alternatively 'U' or 'G'.
AAT-506 25/27mer DsiRNA, mismatch position=5 of antisense strand (from 5'-terminus)

```
5'-UCUUCUUCUCCCCAGUGAGC^AUCgc-3'      (SEQ ID NO: 15)
3'-AUAGAAGAAGAGGGGUCACUCG_AAGCG-5'    (SEQ ID NO: 3337)
```

Optionally, the mismatched 'A' residue of position 5 of the antisense strand is alternatively 'C' or 'G'.
AAT-506 25/27mer DsiRNA, mismatch position=6 of antisense strand (from 5'-terminus)

```
5'-UCUUCUUCUCCCCAGUGAG^CAUCgc-3'      (SEQ ID NO: 15)
3'-AUAGAAGAAGAGGGGUCACUC_AUAGCG-5'    (SEQ ID NO: 3338)
```

Optionally, the mismatched 'A' residue of position 6 of the antisense strand is alternatively 'U' or 'C'.
AAT-506 25/27mer DsiRNA, mismatch position=7 of antisense strand (from 5'-terminus)

```
5'-UCUUCUUCUCCCCAGUGA^GCAUCgc-3'      (SEQ ID NO: 15)
3'-AUAGAAGAAGAGGGGUCACU_UGUAGCG-5'    (SEQ ID NO: 3339)
```

Optionally, the mismatched 'U' residue of position 7 of the antisense strand is alternatively 'A' or 'G'.
  As another example, in the below structures, such mismatches are introduced within the asymmetric AAT-1059 DsiRNA (newly-introduced mismatch residues are italicized):
AAT-1059 25/27mer DsiRNA, mismatch position=19 of sense strand (from 5'-terminus)

```
5'-GCUGUCCAGCUGGGUGCU^ACUGAtg-3'      (SEQ ID NO: 3340)
3'-UUCGACAGGUCGACCCACGA_CGACUAC-5'    (SEQ ID NO: 285)
```

Optionally, the mismatched 'A' residue of position 19 of the sense strand is alternatively 'U' or 'C'.
AAT-1059 25/27mer DsiRNA, mismatch position=20 of sense strand (from 5'-terminus)

```
5'-GCUGUCCAGCUGGGUGCUG^UUGAtg-3'      (SEQ ID NO: 3341)
3'-UUCGACAGGUCGACCCACGAC_GACUAC-5'    (SEQ ID NO: 285)
```

Optionally, the mismatched 'U' residue of position 20 of the sense strand is alternatively 'A' or 'G'.
AAT-1059 25/27mer DsiRNA, mismatch position=21 of sense strand (from 5'-terminus)

```
5'-GCUGUCCAGCUGGGUGCUGC^AGAtg-3'      (SEQ ID NO: 3342)
3'-UUCGACAGGUCGACCCACGACG_ACUAC-5'    (SEQ ID NO: 285)
```

Optionally, the mismatched 'A' residue of position 21 of the sense strand is alternatively 'C' or 'G'.
AAT-1059 25/27mer DsiRNA, mismatch position=22 of sense strand (from 5'-terminus)

```
5'-GCUGUCCAGCUGGGUGCUGCU^UAtg-3'      (SEQ ID NO: 3343)
3'-UUCGACAGGUCGACCCACGACGA_CUAC-5'    (SEQ ID NO: 285)
```

Optionally, the mismatched 'U' residue of position 22 of the sense strand is alternatively 'A' or 'C'.
AAT-1059 25/27mer DsiRNA, mismatch position=23 of sense strand (from 5'-terminus)

```
5'-GCUGUCCAGCUGGGUGCUGCUG^Utg-3'      (SEQ ID NO: 3344)
3'-UUCGACAGGUCGACCCACGACGAC_UAC-5'    (SEQ ID NO: 285)
```

Optionally, the mismatched 'U' residue of position 23 of the sense strand is alternatively 'C' or 'G'.
AAT-1059 25/27mer DsiRNA, mismatch position=24 of sense strand (from 5'-terminus)

```
5'-GCUGUCCAGCUGGGUGCUGCUGA^gg-3'      (SEQ ID NO: 3345)
3'-UUCGACAGGUCGACCCACGACGACU_AC-5'    (SEQ ID NO: 285)
```

Optionally, the mismatched 'g' residue of position 24 of the sense strand is alternatively 'a' or 'c'.
AAT-1059 25/27mer DsiRNA, mismatch position=25 of sense strand (from 5'-terminus)

```
5'-GCUGUCCAGCUGGGUGCUGCUGAt^a-3'      (SEQ ID NO: 3346)
3'-UUCGACAGGUCGACCCACGACGACUA_C-5'    (SEQ ID NO: 285)
```

Optionally, the mismatched 'a' residue of position 25 of the sense strand is alternatively 't' or 'c'.
AAT-1059 25/27mer DsiRNA, mismatch position=1 of antisense strand (from 5'-terminus)

```
5'-GCUGUCCAGCUGGGUGCUGCUGAt^g-3'      (SEQ ID NO: 87)
3'-UUCGACAGGUCGACCCACGACGACUA_U-5'    (SEQ ID NO: 3347)
```

Optionally, the mismatched 'U' residue of position 1 of the antisense strand is alternatively 'A' or 'G'.
AAT-1059 25/27mer DsiRNA, mismatch position=2 of antisense strand (from 5'-terminus)

```
5'-GCUGUCCAGCUGGGUGCUGCUGA^tg-3'      (SEQ ID NO: 87)
3'-UUCGACAGGUCGACCCACGACGACU_CC-5'    (SEQ ID NO: 3348)
```

Optionally, the mismatched 'C' residue of position 2 of the antisense strand is alternatively 'U' or 'G'.
AAT-1059 25/27mer DsiRNA, mismatch position=3 of antisense strand (from 5'-terminus)

```
5'-GCUGUCCAGCUGGGUGCUGCUG^Atg-3'   (SEQ ID NO: 87)
3'-UUCGACAGGUCGACCCACGACGAC_AAC-5' (SEQ ID NO: 3349)
```

Optionally, the mismatched 'A' residue of position 3 of the antisense strand is alternatively 'C' or 'G'.
AAT-1059 25/27mer DsiRNA, mismatch position=4 of antisense strand (from 5'-terminus)

```
5'-GCUGUCCAGCUGGGUGCUGCU^GAtg-3'   (SEQ ID NO: 87)
3'-UUCGACAGGUCGACCCACGACGA_AUAC-5' (SEQ ID NO: 3350)
```

Optionally, the mismatched 'A' residue of position 4 of the antisense strand is alternatively 'U' or 'G'.
AAT-1059 25/27mer DsiRNA, mismatch position=5 of antisense strand (from 5'-terminus)

```
5'-GCUGUCCAGCUGGGUGCUGC^UGAtg-3'   (SEQ ID NO: 87)
3'-UUCGACAGGUCGACCCACGACG_UCUAC-5' (SEQ ID NO: 3351)
```

Optionally, the mismatched 'U' residue of position 5 of the antisense strand is alternatively 'C' or 'G'.
AAT-1059 25/27mer DsiRNA, mismatch position=6 of antisense strand (from 5'-terminus)

```
5'-GCUGUCCAGCUGGGUGCUG^CUGAtg-3'   (SEQ ID NO: 87)
3'-UUCGACAGGUCGACCCACGAC_AACUAC-5' (SEQ ID NO: 3352)
```

Optionally, the mismatched 'A' residue of position 6 of the antisense strand is alternatively 'U' or 'C'.
AAT-1059 25/27mer DsiRNA, mismatch position=7 of antisense strand (from 5'-terminus)

```
5'-GCUGUCCAGCUGGGUGCU^GCUGAtg-3'   (SEQ ID NO: 87)
3'-UUCGACAGGUCGACCCACGA_UGACUAC-5' (SEQ ID NO: 3353)
```

Optionally, the mismatched 'U' residue of position 7 of the antisense strand is alternatively 'A' or 'G'.

For the above oligonucleotide strand sequences, it is contemplated that the sense strand sequence of one depicted duplex can be combined with an antisense strand of another depicted duplex, thereby forming a distinct duplex—in certain instances, such duplexes contain a mismatched residue with respect to the α-1 antitrypsin target transcript sequence, while such sense and antisense strand sequences do not present a mismatch at this residue with respect to one another (e.g., duplexes comprising SEQ ID NOs: 3326 and 3339; SEQ ID NOs: 3327 and 3338; SEQ ID NOs: 3328 and 3337, etc., are contemplated as exemplary of such duplexes).

As noted above, introduction of mismatches can be performed upon any of the DsiRNAs described herein.

The mismatches of such DsiRNA structures can be combined to produce a DsiRNA possessing, e.g., two, three or even four mismatches within the 3'-terminal four to seven nucleotides of the sense strand/5'-terminal four to seven nucleotides of the antisense strand.

Indeed, in view of the flexibility of sequences which can be incorporated into DsiRNAs at the 3'-terminal residues of the sense strand/5'-terminal residues of the antisense strand, in certain embodiments, the sequence requirements of an asymmetric DsiRNA of the instant invention can be represented as the following (minimalist) structure (shown for an exemplary α-1 antitrypsin-506 DsiRNA sequence):

```
                                    (SEQ ID NO: 3354)
        5'-UCUUCUUCUCCCCAGUGAXXXXXX[X]_n-3'

(SEQ ID NO: 3355)
        3'-AUAGAAGAAGAGGGGUCACUXXXXXX[X]_n-5'
``` where n=1 to 5, 1 to 10, 1 to 20, 1 to 30, 1 to 50, or 1 to 80 or more.

α-1 antitrypsin-506 mRNA Target: 5'-UAUCUUCUUCUC-CCCAGUGAXXXXXXX-3' (SEQ ID NO: 3356).

The α-1 antitrypsin target site may also be a site which is targeted by one or more of several oligonucleotides whose complementary target sites overlap with a stated target site. For example, for an exemplary α-1 antitrypsin-506 DsiRNA, it is noted that certain DsiRNAs targeting overlapping and only slightly offset α-1 antitrypsin sequences could exhibit activity levels similar to that of α-1 antitrypsin-506 (e.g., α-1 antitrypsin-500 to 513 of Table 2 above). Thus, in certain embodiments, a designated target sequence region might be effectively targeted by a series of DsiRNAs possessing largely overlapping sequences. (E.g., if considering DsiRNAs of the α-1 antitrypsin-500 to α-1 antitrypsin-513 target site(s), a more encompassing α-1 antitrypsin transcript target sequence might be recited as, e.g., 5'-CACCAAUAUCUUCUUCUCCCCAGUGAG-CAUCGCU-3' (SEQ ID NO: 3357), wherein any given DsiRNA (e.g., a DsiRNA selected from α-1 antitrypsin-500 to α-1 antitrypsin-513) only targets a sub-sequence within such a sequence region, yet the entire sequence can be considered a viable target for such a series of DsiRNAs).

Additionally and/or alternatively, mismatches within the 3'-terminal seven nucleotides of the sense strand/5'-terminal seven nucleotides of the antisense strand can be combined with mismatches positioned at other mismatch-tolerant positions, as described above.

In view of the present identification of the above-described Dicer substrate agents (DsiRNAs) as inhibitors of α-1 antitrypsin levels via targeting of specific α-1 antitrypsin sequences, it is also recognized that dsRNAs having structures similar to those described herein can also be synthesized which target other sequences within the α-1 antitrypsin sequence of NM_000295.4, or within variants thereof (e.g., target sequences possessing 80% identity, 90% identity, 95% identity, 96% identity, 97% identity, 98% identity, 99% or more identity to a sequence of NM_000295.4).

Anti-α-1 Antitrypsin DsiRNA Design/Synthesis

It has been found empirically that longer dsRNA species of from 25 to 35 nucleotides (DsiRNAs) and especially from 25 to 30 nucleotides give unexpectedly effective results in terms of potency and duration of action, as compared to 19-23mer siRNA agents. Without wishing to be bound by the underlying theory of the dsRNA processing mechanism, it is thought that the longer dsRNA species serve as a substrate for the Dicer enzyme in the cytoplasm of a cell. In addition to cleaving the dsRNA of the invention into shorter segments, Dicer is thought to facilitate the incorporation of a single-stranded cleavage product derived from the cleaved dsRNA into the RISC complex that is responsible for the destruction of the cytoplasmic RNA (e.g., α-1 antitrypsin RNA) of or derived from the target gene, α-1 antitrypsin (or other gene associated with a α-1 antitrypsin-associated disease or disorder). Prior studies (Rossi et al., U.S. Patent Application No. 2007/0265220) have shown that the cleavability of a dsRNA species (specifically, a DsiRNA agent) by Dicer corresponds with increased potency and duration of action of the dsRNA species.

Certain preferred anti-α-1 antitrypsin DsiRNA agents were selected from a pre-screened population. Design of DsiRNAs can optionally involve use of predictive scoring algorithms that perform in silico assessments of the projected activity/efficacy of a number of possible DsiRNA agents spanning a region of sequence. Information regarding the design of such scoring algorithms can be found, e.g., in Gong et al. (*BMC Bioinformatics* 2006, 7:516), though a more recent "v4.3" algorithm represents a theoretically improved algorithm relative to siRNA scoring algorithms previously available in the art. (E.g., "v3" and "v4" scoring algorithms are machine learning algorithms that are not reliant upon any biases in human sequence. In addition, the "v3" and "v4" algorithms derive from data sets that are many-fold larger than that from which an older "v2" algorithm such as that described in Gong et al. derives.)

The first and second oligonucleotides of the DsiRNA agents of the instant invention are not required to be completely complementary. In fact, in one embodiment, the 3'-terminus of the sense strand contains one or more mismatches. In one aspect, two mismatches are incorporated at the 3' terminus of the sense strand. In another embodiment, the DsiRNA of the invention is a double stranded RNA molecule containing two RNA oligonucleotides each of which is 27 nucleotides in length and, when annealed to each other, have blunt ends and a two nucleotide mismatch on the 3'-terminus of the sense strand (the 5'-terminus of the antisense strand). The use of mismatches or decreased thermodynamic stability (specifically at the 3'-sense/5'-antisense position) has been proposed to facilitate or favor entry of the antisense strand into RISC (Schwarz et al., 2003, *Cell* 115: 199-208; Khvorova et al., 2003, *Cell* 115: 209-216), presumably by affecting some rate-limiting unwinding steps that occur with entry of the siRNA into RISC. Thus, terminal base composition has been included in design algorithms for selecting active 21mer siRNA duplexes (Ui-Tei et al., 2004, *Nucleic Acids Res* 32: 936-948; Reynolds et al., 2004, *Nat Biotechnol* 22: 326-330). With Dicer cleavage of the dsRNA of this embodiment, the small end-terminal sequence which contains the mismatches will either be left unpaired with the antisense strand (become part of a 3'-overhang) or be cleaved entirely off the final 21-mer siRNA. These "mismatches", therefore, do not persist as mismatches in the final RNA component of RISC. The finding that base mismatches or destabilization of segments at the 3'-end of the sense strand of Dicer substrate improved the potency of synthetic duplexes in RNAi, presumably by facilitating processing by Dicer, was a surprising finding of past works describing the design and use of 25-30mer dsRNAs (also termed "DsiRNAs" herein; Rossi et al., U.S. Patent Application Nos. 2005/0277610, 2005/0244858 and 2007/0265220).

Modification of Anti-α-1 Antitrypsin dsRNAs

One major factor that inhibits the effect of double stranded RNAs ("dsRNAs") is the degradation of dsRNAs (e.g., siRNAs and DsiRNAs) by nucleases. A 3'-exonuclease is the primary nuclease activity present in serum and modification of the 3'-ends of antisense DNA oligonucleotides is crucial to prevent degradation (Eder et al., 1991, *Antisense Res Dev,* 1: 141-151). An RNase-T family nuclease has been identified called ERI-1 which has 3' to 5' exonuclease activity that is involved in regulation and degradation of siRNAs (Kennedy et al., 2004, *Nature* 427: 645-649; Hong et al., 2005, *Biochem J*, 390: 675-679). This gene is also known as Thex1 (NM_02067) in mice or THEX1 (NM_153332) in humans and is involved in degradation of histone mRNA; it also mediates degradation of 3'-overhangs in siRNAs, but does not degrade duplex RNA (Yang et al., 2006, *J Biol Chem,* 281: 30447-30454). It is therefore reasonable to expect that 3'-end-stabilization of dsRNAs, including the DsiRNAs of the instant invention, will improve stability.

XRN1 (NM_019001) is a 5' to 3' exonuclease that resides in P-bodies and has been implicated in degradation of mRNA targeted by miRNA (Rehwinkel et al., 2005, *RNA* 11: 1640-1647) and may also be responsible for completing degradation initiated by internal cleavage as directed by a siRNA. XRN2 (NM_012255) is a distinct 5' to 3' exonuclease that is involved in nuclear RNA processing.

RNase A is a major endonuclease activity in mammals that degrades RNAs. It is specific for ssRNA and cleaves at the 3'-end of pyrimidine bases. SiRNA degradation products consistent with RNase A cleavage can be detected by mass spectrometry after incubation in serum (Turner et al., 2007, *Mol Biosyst* 3: 43-50). The 3'-overhangs enhance the susceptibility of siRNAs to RNase degradation. Depletion of RNase A from serum reduces degradation of siRNAs; this degradation does show some sequence preference and is worse for sequences having poly A/U sequence on the ends (Haupenthal et al., 2006 *Biochem Pharmacol* 71: 702-710). This suggests the possibility that lower stability regions of the duplex may "breathe" and offer transient single-stranded species available for degradation by RNase A. RNase A inhibitors can be added to serum and improve siRNA longevity and potency (Haupenthal et al., 2007, *Int J. Cancer* 121: 206-210).

In 21mers, phosphorothioate or boranophosphate modifications directly stabilize the internucleoside phosphate linkage. Boranophosphate modified RNAs are highly nuclease resistant, potent as silencing agents, and are relatively non-toxic. Boranophosphate modified RNAs cannot be manufactured using standard chemical synthesis methods and instead are made by in vitro transcription (IVT) (Hall et al., 2004, *Nucleic Acids Res* 32: 5991-6000; Hall et al., 2006, *Nucleic Acids Res* 34: 2773-2781). Phosphorothioate (PS) modifications can be easily placed in the RNA duplex at any desired position and can be made using standard chemical synthesis methods. The PS modification shows dose-dependent toxicity, so most investigators have recommended limited incorporation in siRNAs, favoring the 3'-ends where protection from nucleases is most important (Harborth et al., 2003, *Antisense Nucleic Acid Drug Dev* 13: 83-105; Chiu and Rana, 2003, *Mol Cell* 10: 549-561; Braasch et al., 2003, *Biochemistry* 42: 7967-7975; Amarzguioui et al., 2003, *Nucleic Acids Research* 31: 589-595). More extensive PS modification can be compatible with potent RNAi activity; however, use of sugar modifications (such as 2'-O-methyl RNA) may be superior (Choung et al., 2006, *Biochem Biophys Res Commun* 342: 919-927).

A variety of substitutions can be placed at the 2'-position of the ribose which generally increases duplex stability ($T_m$) and can greatly improve nuclease resistance. 2'-O-methyl RNA is a naturally occurring modification found in mammalian ribosomal RNAs and transfer RNAs. 2'-O-methyl modification in siRNAs is known, but the precise position of modified bases within the duplex is important to retain potency and complete substitution of 2'-O-methyl RNA for RNA will inactivate the siRNA. For example, a pattern that employs alternating 2'-O-methyl bases can have potency equivalent to unmodified RNA and is quite stable in serum (Choung et al., 2006, *Biochem Biophys Res Commun* 342: 919-927; Czauderna et al., 2003, *Nucleic Acids Research* 31: 2705-2716).

The 2'-fluoro (2'-F) modification is also compatible with dsRNA (e.g., siRNA and DsiRNA) function; it is most commonly placed at pyrimidine sites (due to reagent cost and availability) and can be combined with 2'-O-methyl modification at purine positions; 2'-F purines are available and can also be used. Heavily modified duplexes of this kind can be potent triggers of RNAi in vitro (Allerson et al., 2005, *J Med Chem* 48: 901-904; Prakash et al., 2005, *J Med Chem* 48: 4247-4253; Kraynack and Baker, 2006, *RNA* 12: 163-176) and can improve performance and extend duration of action when used in vivo (Morrissey et al., 2005, *Hepatology* 41: 1349-1356; Morrissey et al., 2005, *Nat Biotechnol* 23: 1002-1007). A highly potent, nuclease stable, blunt 19mer duplex containing alternative 2'-F and 2'-O-Me bases is taught by Allerson. In this design, alternating 2'-O-Me residues are positioned in an identical pattern to that employed by Czauderna, however the remaining RNA residues are converted to 2'-F modified bases. A highly potent, nuclease resistant siRNA employed by Morrissey employed a highly potent, nuclease resistant siRNA in vivo. In addition to 2'-O-Me RNA and 2'-F RNA, this duplex includes DNA, RNA, inverted abasic residues, and a 3'-terminal PS internucleoside linkage. While extensive modification has certain benefits, more limited modification of the duplex can also improve in vivo performance and is both simpler and less costly to manufacture. Soutschek et al. (2004, *Nature* 432: 173-178) employed a duplex in vivo and was mostly RNA with two 2'-O-Me RNA bases and limited 3'-terminal PS internucleoside linkages.

Locked nucleic acids (LNAs) are a different class of 2'-modification that can be used to stabilize dsRNA (e.g., siRNA and DsiRNA). Patterns of LNA incorporation that retain potency are more restricted than 2'-O-methyl or 2'-F bases, so limited modification is preferred (Braasch et al., 2003, *Biochemistry* 42: 7967-7975; Grunweller et al., 2003, *Nucleic Acids Res* 31: 3185-3193; Elmen et al., 2005, *Nucleic Acids Res* 33: 439-447). Even with limited incorporation, the use of LNA modifications can improve dsRNA performance in vivo and may also alter or improve off target effect profiles (Mook et al., 2007, *Mol Cancer Ther* 6: 833-843).

Synthetic nucleic acids introduced into cells or live animals can be recognized as "foreign" and trigger an immune response. Immune stimulation constitutes a major class of off-target effects which can dramatically change experimental results and even lead to cell death. The innate immune system includes a collection of receptor molecules that specifically interact with DNA and RNA that mediate these responses, some of which are located in the cytoplasm and some of which reside in endosomes (Marques and Williams, 2005, *Nat Biotechnol* 23: 1399-1405; Schlee et al., 2006, *Mol Ther* 14: 463-470). Delivery of siRNAs by cationic lipids or liposomes exposes the siRNA to both cytoplasmic and endosomal compartments, maximizing the risk for triggering a type 1 interferon (IFN) response both in vitro and in vivo (Morrissey et al., 2005, *Nat Biotechnol* 23: 1002-1007; Sioud and Sorensen, 2003, *Biochem Biophys Res Commun* 312: 1220-1225; Sioud, 2005, *J Mol Biol* 348: 1079-1090; Ma et al., 2005, *Biochem Biophys Res Commun* 330: 755-759). RNAs transcribed within the cell are less immunogenic (Robbins et al., 2006, *Nat Biotechnol* 24: 566-571) and synthetic RNAs that are immunogenic when delivered using lipid-based methods can evade immune stimulation when introduced unto cells by mechanical means, even in vivo (Heidel et al., 2004, *Nat Biotechnol* 22: 1579-1582). However, lipid based delivery methods are convenient, effective, and widely used. Some general strategy to prevent immune responses is needed, especially for in vivo application where all cell types are present and the risk of generating an immune response is highest. Use of chemically modified RNAs may solve most or even all of these problems.

In certain embodiments, modifications can be included in the anti-α-1 antitrypsin dsRNA agents of the present invention so long as the modification does not prevent the dsRNA agent from possessing α-1 antitrypsin inhibitory activity. In one embodiment, one or more modifications are made that enhance Dicer processing of the DsiRNA agent (an assay for determining Dicer processing of a DsiRNA is described elsewhere herein). In a second embodiment, one or more modifications are made that result in more effective α-1 antitrypsin inhibition (as described herein, α-1 antitrypsin inhibition/α-1 antitrypsin inhibitory activity of a dsRNA can be assayed via art-recognized methods for determining RNA levels, or for determining α-1 antitrypsin polypeptide levels, should such levels be assessed in lieu of or in addition to assessment of, e.g., α-1 antitrypsin mRNA levels). In a third embodiment, one or more modifications are made that support greater α-1 antitrypsin inhibitory activity (means of determining α-1 antitrypsin inhibitory activity are described supra). In a fourth embodiment, one or more modifications are made that result in greater potency of α-1 antitrypsin inhibitory activity per each dsRNA agent molecule to be delivered to the cell (potency of α-1 antitrypsin inhibitory activity is described supra). Modifications can be incorporated in the 3'-terminal region, the 5'-terminal region, in both the 3'-terminal and 5'-terminal region or in some instances in various positions within the sequence. With the restrictions noted above in mind, numbers and combinations of modifications can be incorporated into the dsRNA agent. Where multiple modifications are present, they may be the same or different. Modifications to bases, sugar moieties, the phosphate backbone, and their combinations are contemplated. Either 5'-terminus can be phosphorylated.

Examples of modifications contemplated for the phosphate backbone include phosphonates, including methylphosphonate, phosphorothioate, and phosphotriester modifications such as alkylphosphotriesters, and the like. Examples of modifications contemplated for the sugar moiety include 2'-alkyl pyrimidine, such as 2'-O-methyl, 2'-fluoro, amino, and deoxy modifications and the like (see, e.g., Amarzguioui et al., 2003, *Nucleic Acids Research* 31: 589-595). Examples of modifications contemplated for the base groups include abasic sugars, 2-O-alkyl modified pyrimidines, 4-thiouracil, 5-bromouracil, 5-iodouracil, and 5-(3-aminoallyl)-uracil and the like. Locked nucleic acids, or LNA's, could also be incorporated. Many other modifications are known and can be used so long as the above criteria are satisfied. Examples of modifications are also disclosed in U.S. Pat. Nos. 5,684,143, 5,858,988 and 6,291,438 and in U.S. published patent application No. 2004/0203145 A1. Other modifications are disclosed in Herdewijn (2000, *Antisense Nucleic Acid Drug Dev* 10: 297-310), Eckstein (2000, *Antisense Nucleic Acid Drug Dev* 10: 117-21), Rusckowski et al. (2000, *Antisense Nucleic Acid Drug Dev* 10: 333-345), Stein et al. (2001, *Antisense Nucleic Acid*

Drug Dev 11: 317-25); Vorobjev et al. (2001, *Antisense Nucleic Acid Drug Dev* 11: 77-85).

One or more modifications contemplated can be incorporated into either strand. The placement of the modifications in the dsRNA agent can greatly affect the characteristics of the dsRNA agent, including conferring greater potency and stability, reducing toxicity, enhance Dicer processing, and minimizing an immune response. In one embodiment, the antisense strand or the sense strand or both strands have one or more 2'-O-methyl modified nucleotides. In another embodiment, the antisense strand contains 2'-O-methyl modified nucleotides. In another embodiment, the antisense stand contains a 3' overhang that is comprised of 2'-O-methyl modified nucleotides. The antisense strand could also include additional 2'-O-methyl modified nucleotides.

In certain embodiments, the anti-α-1 antitrypsin DsiRNA agent of the invention has several properties which enhance its processing by Dicer. According to such embodiments, the DsiRNA agent has a length sufficient such that it is processed by Dicer to produce an siRNA and at least one of the following properties: (i) the DsiRNA agent is asymmetric, e.g., has a 3' overhang on the sense strand and (ii) the DsiRNA agent has a modified 3' end on the antisense strand to direct orientation of Dicer binding and processing of the dsRNA to an active siRNA. According to these embodiments, the longest strand in the DsiRNA agent comprises 25-30 nucleotides. In one embodiment, the sense strand comprises 25-30 nucleotides and the antisense strand comprises 25-28 nucleotides. Thus, the resulting dsRNA has an overhang on the 3' end of the sense strand. The overhang is 1-4 nucleotides, such as 2 nucleotides. The antisense strand may also have a 5' phosphate.

In certain embodiments, the sense strand of a DsiRNA agent is modified for Dicer processing by suitable modifiers located at the 3' end of the sense strand, i.e., the DsiRNA agent is designed to direct orientation of Dicer binding and processing. Suitable modifiers include nucleotides such as deoxyribonucleotides, dideoxyribonucleotides, acyclonucleotides and the like and sterically hindered molecules, such as fluorescent molecules and the like. Acyclonucleotides substitute a 2-hydroxyethoxymethyl group for the 2'-deoxyribofuranosyl sugar normally present in dNMPs. Other nucleotide modifiers could include 3'-deoxyadenosine (cordycepin), 3'-azido-3'-deoxythymidine (AZT), 2',3'-dideoxyinosine (ddI), 2',3'-dideoxy-3'-thiacytidine (3TC), 2',3'-didehydro-2',3'-dideoxythymidine (d4T) and the monophosphate nucleotides of 3'-azido-3'-deoxythymidine (AZT), 2',3'-dideoxy-3'-thiacytidine (3TC) and 2',3'-didehydro-2',3'-dideoxythymidine (d4T). In one embodiment, deoxynucleotides are used as the modifiers. When nucleotide modifiers are utilized, 1-3 nucleotide modifiers, or 2 nucleotide modifiers are substituted for the ribonucleotides on the 3' end of the sense strand. When sterically hindered molecules are utilized, they are attached to the ribonucleotide at the 3' end of the antisense strand. Thus, the length of the strand does not change with the incorporation of the modifiers. In another embodiment, the invention contemplates substituting two DNA bases in the dsRNA to direct the orientation of Dicer processing. In a further invention, two terminal DNA bases are located on the 3' end of the sense strand in place of two ribonucleotides forming a blunt end of the duplex on the 5' end of the antisense strand and the 3' end of the sense strand, and a two-nucleotide RNA overhang is located on the 3'-end of the antisense strand. This is an asymmetric composition with DNA on the blunt end and RNA bases on the overhanging end.

In certain other embodiments, the antisense strand of a DsiRNA agent is modified for Dicer processing by suitable modifiers located at the 3' end of the antisense strand, i.e., the DsiRNA agent is designed to direct orientation of Dicer binding and processing. Suitable modifiers include nucleotides such as deoxyribonucleotides, dideoxyribonucleotides, acyclonucleotides and the like and sterically hindered molecules, such as fluorescent molecules and the like. Acyclonucleotides substitute a 2-hydroxyethoxymethyl group for the 2'-deoxyribofuranosyl sugar normally present in dNMPs. Other nucleotide modifiers could include 3'-deoxyadenosine (cordycepin), 3'-azido-3'-deoxythymidine (AZT), 2',3'-dideoxyinosine (ddI), 2',3'-dideoxy-3'-thiacytidine (3TC), 2',3'-didehydro-2',3'-dideoxythymidine (d4T) and the monophosphate nucleotides of 3'-azido-3'-deoxythymidine (AZT), 2',3'-dideoxy-3'-thiacytidine (3TC) and 2',3'-didehydro-2',3'-dideoxythymidine (d4T). In one embodiment, deoxynucleotides are used as the modifiers. When nucleotide modifiers are utilized, 1-3 nucleotide modifiers, or 2 nucleotide modifiers are substituted for the ribonucleotides on the 3' end of the antisense strand. When sterically hindered molecules are utilized, they are attached to the ribonucleotide at the 3' end of the antisense strand. Thus, the length of the strand does not change with the incorporation of the modifiers. In another embodiment, the invention contemplates substituting two DNA bases in the dsRNA to direct the orientation of Dicer processing. In a further invention, two terminal DNA bases are located on the 3' end of the antisense strand in place of two ribonucleotides forming a blunt end of the duplex on the 5' end of the sense strand and the 3' end of the antisense strand, and a two-nucleotide RNA overhang is located on the 3'-end of the sense strand. This is also an asymmetric composition with DNA on the blunt end and RNA bases on the overhanging end.

The sense and antisense strands anneal under biological conditions, such as the conditions found in the cytoplasm of a cell. In addition, a region of one of the sequences, particularly of the antisense strand, of the dsRNA has a sequence length of at least 19 nucleotides, wherein these nucleotides are adjacent to the 3' end of antisense strand and are sufficiently complementary to a nucleotide sequence of the target α-1 antitrypsin RNA.

Additionally, the DsiRNA agent structure can be optimized to ensure that the oligonucleotide segment generated from Dicer's cleavage will be the portion of the oligonucleotide that is most effective in inhibiting gene expression. For example, in one embodiment of the invention, a 27-bp oligonucleotide of the DsiRNA agent structure is synthesized wherein the anticipated 21 to 22-bp segment that will inhibit gene expression is located on the 3'-end of the antisense strand. The remaining bases located on the 5'-end of the antisense strand will be cleaved by Dicer and will be discarded. This cleaved portion can be homologous (i.e., based on the sequence of the target sequence) or non-homologous and added to extend the nucleic acid strand.

US 2007/0265220 discloses that 27mer DsiRNAs showed improved stability in serum over comparable 21mer siRNA compositions, even absent chemical modification. Modifications of DsiRNA agents, such as inclusion of 2'-O-methyl RNA in the antisense strand, in patterns such as detailed above, when coupled with addition of a 5' Phosphate, can improve stability of DsiRNA agents. Addition of 5'-phosphate to all strands in synthetic RNA duplexes may be an inexpensive and physiological method to confer some limited degree of nuclease stability.

The chemical modification patterns of the dsRNA agents of the instant invention are designed to enhance the efficacy of such agents. Accordingly, such modifications are designed to avoid reducing potency of dsRNA agents; to avoid interfering with Dicer processing of DsiRNA agents; to improve stability in biological fluids (reduce nuclease sensitivity) of dsRNA agents; or to block or evade detection by the innate immune system. Such modifications are also designed to avoid being toxic and to avoid increasing the cost or impact the ease of manufacturing the instant dsRNA agents of the invention.

In certain embodiments of the present invention, an anti-α-1 antitrypsin DsiRNA agent has one or more of the following properties: (i) the DsiRNA agent is asymmetric, e.g., has a 3' overhang on the antisense strand and (ii) the DsiRNA agent has a modified 3' end on the sense strand to direct orientation of Dicer binding and processing of the dsRNA to an active siRNA. According to this embodiment, the longest strand in the dsRNA comprises 25-35 nucleotides (e.g., 25, 26, 27, 28, 29, 30, 31, 32, 33, 34 or 35 nucleotides). In certain such embodiments, the DsiRNA agent is asymmetric such that the sense strand comprises 25-34 nucleotides and the 3' end of the sense strand forms a blunt end with the 5' end of the antisense strand while the antisense strand comprises 26-35 nucleotides and forms an overhang on the 3' end of the antisense strand. In one embodiment, the DsiRNA agent is asymmetric such that the sense strand comprises 25-28 nucleotides and the antisense strand comprises 25-30 nucleotides. Thus, the resulting dsRNA has an overhang on the 3' end of the antisense strand. The overhang is 1-4 nucleotides, for example 2 nucleotides. The sense strand may also have a 5' phosphate.

The DsiRNA agent can also have one or more of the following additional properties: (a) the antisense strand has a right shift from the typical 21mer (e.g., the DsiRNA comprises a length of antisense strand nucleotides that extends to the 5' of a projected Dicer cleavage site within the DsiRNA, with such antisense strand nucleotides base paired with corresponding nucleotides of the sense strand extending 3' of a projected Dicer cleavage site in the sense strand), (b) the strands may not be completely complementary, i.e., the strands may contain simple mismatched base pairs (in certain embodiments, the DsiRNAs of the invention possess 1, 2, 3, 4 or even 5 or more mismatched base pairs, provided that α-1 antitrypsin inhibitory activity of the DsiRNA possessing mismatched base pairs is retained at sufficient levels (e.g., retains at least 50% α-1 antitrypsin inhibitory activity or more, at least 60% α-1 antitrypsin inhibitory activity or more, at least 70% α-1 antitrypsin inhibitory activity or more, at least 80% α-1 antitrypsin inhibitory activity or more, at least 90% α-1 antitrypsin inhibitory activity or more or at least 95% α-1 antitrypsin inhibitory activity or more as compared to a corresponding DsiRNA not possessing mismatched base pairs. In certain embodiments, mismatched base pairs exist between the antisense and sense strands of a DsiRNA. In some embodiments, mismatched base pairs exist (or are predicted to exist) between the antisense strand and the target RNA. In certain embodiments, the presence of a mismatched base pair(s) between an antisense strand residue and a corresponding residue within the target RNA that is located 3' in the target RNA sequence of a projected Ago2 cleavage site retains and may even enhance α-1 antitrypsin inhibitory activity of a DsiRNA of the invention) and (c) base modifications such as locked nucleic acid(s) may be included in the 5' end of the sense strand. A "typical" 21mer siRNA is designed using conventional techniques. In one technique, a variety of sites are commonly tested in parallel or pools containing several distinct siRNA duplexes specific to the same target with the hope that one of the reagents will be effective (Ji et al., 2003, FEBS Lett 552: 247-252). Other techniques use design rules and algorithms to increase the likelihood of obtaining active RNAi effector molecules (Schwarz et al., 2003, Cell 115: 199-208; Khvorova et al., 2003, Cell 115: 209-216; Ui-Tei et al., 2004, Nucleic Acids Res 32: 936-948; Reynolds et al., 2004, Nat Biotechnol 22: 326-330; Krol et al., 2004, J Biol Chem 279: 42230-42239; Yuan et al., 2004, Nucl Acids Res 32(Webserver issue):W130-134; Boese et al., 2005, Methods Enzymol 392: 73-96). High throughput selection of siRNA has also been developed (U.S. published patent application No. 2005/0042641 A1). Potential target sites can also be analyzed by secondary structure predictions (Heale et al., 2005, Nucleic Acids Res 33(3): e30). This 21mer is then used to design a right shift to include 3-9 additional nucleotides on the 5' end of the 21mer. The sequence of these additional nucleotides is not restricted. In one embodiment, the added ribonucleotides are based on the sequence of the target gene. Even in this embodiment, full complementarity between the target sequence and the antisense siRNA is not required.

The first and second oligonucleotides of a DsiRNA agent of the instant invention are not required to be completely complementary. They only need to be sufficiently complementary to anneal under biological conditions and to provide a substrate for Dicer that produces a siRNA sufficiently complementary to the target sequence. Locked nucleic acids, or LNA's, are well known to a skilled artisan (Elmen et al., 2005, Nucleic Acids Res 33: 439-447; Kurreck et al., 2002, Nucleic Acids Res 30: 1911-1918; Crinelli et al., 2002, Nucleic Acids Res 30: 2435-2443; Braasch and Corey, 2001, Chem Biol 8: 1-7; Bondensgaard et al., 2000, Chemistry 6: 2687-2695; Wahlestedt et al., 2000, Proc Natl Acad Sci USA 97: 5633-5638). In one embodiment, an LNA is incorporated at the 5' terminus of the sense strand. In another embodiment, an LNA is incorporated at the 5' terminus of the sense strand in duplexes designed to include a 3' overhang on the antisense strand.

In certain embodiments, the DsiRNA agent of the instant invention has an asymmetric structure, with the sense strand having a 25-base pair length, and the antisense strand having a 27-base pair length with a 2 base 3'-overhang. In other embodiments, this DsiRNA agent having an asymmetric structure further contains 2 deoxynucleotides at the 3' end of the sense strand in place of two of the ribonucleotides.

Certain DsiRNA agent compositions containing two separate oligonucleotides can be linked by a third structure. The third structure will not block Dicer activity on the DsiRNA agent and will not interfere with the directed destruction of the RNA transcribed from the target gene. In one embodiment, the third structure may be a chemical linking group. Many suitable chemical linking groups are known in the art and can be used. Alternatively, the third structure may be an oligonucleotide that links the two oligonucleotides of the DsiRNA agent in a manner such that a hairpin structure is produced upon annealing of the two oligonucleotides making up the dsRNA composition. The hairpin structure will not block Dicer activity on the DsiRNA agent and will not interfere with the directed destruction of the α-1 antitrypsin RNA.

In Vitro Assay to Assess dsRNA α-1 Antitrypsin Inhibitory Activity

An in vitro assay that recapitulates RNAi in a cell-free system can be used to evaluate dsRNA constructs targeting α-1 antitrypsin RNA sequence(s), and thus to assess α-1 antitrypsin-specific gene inhibitory activity (also referred to herein as α-1 antitrypsin inhibitory activity) of a dsRNA. The assay comprises the system described by Tuschl et al., 1999, Genes and Development, 13, 3191-3197 and Zamore et al., 2000, Cell, 101, 25-33 adapted for use with dsRNA (e.g., DsiRNA) agents directed against α-1 antitrypsin RNA. A *Drosophila* extract derived from syncytial blastoderm is used to reconstitute RNAi activity in vitro. Target RNA is generated via in vitro transcription from a selected α-1 antitrypsin expressing plasmid using T7 RNA polymerase or via chemical synthesis. Sense and antisense dsRNA strands (for example, 20 uM each) are annealed by incubation in buffer (such as 100 mM potassium acetate, 30 mM HEPES-KOH, pH 7.4, 2 mM magnesium acetate) for 1 minute at 90° C. followed by 1 hour at 37° C., then diluted in lysis buffer (for example 100 mM potassium acetate, 30 mM HEPES-KOH at pH 7.4, 2 mM magnesium acetate). Annealing can be monitored by gel electrophoresis on an agarose gel in TBE buffer and stained with ethidium bromide. The *Drosophila* lysate is prepared using zero to two-hour-old embryos from Oregon R flies collected on yeasted molasses agar that are dechorionated and lysed. The lysate is centrifuged and the supernatant isolated. The assay comprises a reaction mixture containing 50% lysate [vol/vol], RNA (10-50 pM final concentration), and 10% [vol/vol] lysis buffer containing dsRNA (10 nM final concentration). The reaction mixture also contains 10 mM creatine phosphate, 10 ug/ml creatine phosphokinase, 100 um GTP, 100 uM UTP, 100 uM CTP, 500 uM ATP, 5 mM DTT, 0.1 U/uL RNasin (Promega), and 100 uM of each amino acid. The final concentration of potassium acetate is adjusted to 100 mM. The reactions are pre-assembled on ice and preincubated at 25° C. for 10 minutes before adding RNA, then incubated at 25° C. for an additional 60 minutes. Reactions are quenched with 4 volumes of 1.25× Passive Lysis Buffer (Promega). Target RNA cleavage is assayed by RT-PCR analysis or other methods known in the art and are compared to control reactions in which dsRNA is omitted from the reaction.

Alternately, internally-labeled target RNA for the assay is prepared by in vitro transcription in the presence of [α-$^{32}$P] CTP, passed over a G50 Sephadex column by spin chromatography and used as target RNA without further purification. Optionally, target RNA is 5'-$^{32}$P-end labeled using T4 polynucleotide kinase enzyme. Assays are performed as described above and target RNA and the specific RNA cleavage products generated by RNAi are visualized on an autoradiograph of a gel. The percentage of cleavage is determined by PHOSPHOR IMAGER® (autoradiography) quantitation of bands representing intact control RNA or RNA from control reactions without dsRNA and the cleavage products generated by the assay.

In one embodiment, this assay is used to determine target sites in the α-1 antitrypsin RNA target for dsRNA mediated RNAi cleavage, wherein a plurality of dsRNA constructs are screened for RNAi mediated cleavage of the α-1 antitrypsin RNA target, for example, by analyzing the assay reaction by electrophoresis of labeled target RNA, or by northern blotting, as well as by other methodology well known in the art.

In certain embodiments, a dsRNA of the invention is deemed to possess α-1 antitrypsin inhibitory activity if, e.g., a 50% reduction in α-1 antitrypsin RNA levels is observed in a system, cell, tissue or organism, relative to a suitable control. Additional metes and bounds for determination of α-1 antitrypsin inhibitory activity of a dsRNA of the invention are described supra.

Conjugation and Delivery of Anti-α-1 Antitrypsin dsRNA Agents

In certain embodiments the present invention relates to a method for treating a subject having a α-1 antitrypsin-associated disease or disorder, or at risk of developing a α-1 antitrypsin-associated disease or disorder. In such embodiments, the dsRNA can act as novel therapeutic agents for controlling the α-1 antitrypsin-associated disease or disorder. The method comprises administering a pharmaceutical composition of the invention to the patient (e.g., human), such that the expression, level and/or activity of a α-1 antitrypsin RNA is reduced. The expression, level and/or activity of a polypeptide encoded by a α-1 antitrypsin RNA might also be reduced by a dsRNA of the instant invention, even where said dsRNA is directed against a non-coding region of the α-1 antitrypsin transcript (e.g., a targeted 5' UTR or 3' UTR sequence). Because of their high specificity, the dsRNAs of the present invention can specifically target α-1 antitrypsin sequences of cells and tissues, optionally in an allele-specific manner where polymorphic alleles exist within an individual and/or population.

In the treatment of a α-1 antitrypsin-associated disease or disorder, the dsRNA can be brought into contact with the cells or tissue of a subject, e.g., the cells or tissue of a subject exhibiting disregulation of α-1 antitrypsin and/or otherwise targeted for reduction of α-1 antitrypsin levels. For example, dsRNA substantially identical to all or part of a α-1 antitrypsin RNA sequence, may be brought into contact with or introduced into such a cell, either in vivo or in vitro. Similarly, dsRNA substantially identical to all or part of a α-1 antitrypsin RNA sequence may administered directly to a subject having or at risk of developing a α-1 antitrypsin-associated disease or disorder.

Therapeutic use of the dsRNA agents of the instant invention can involve use of formulations of dsRNA agents comprising multiple different dsRNA agent sequences. For example, two or more, three or more, four or more, five or more, etc. of the presently described agents can be combined to produce a formulation that, e.g., targets multiple different regions of the α-1 antitrypsin RNA, or that not only target α-1 antitrypsin RNA but also target, e.g., cellular target genes associated with a α-1 antitrypsin-associated disease or disorder. A dsRNA agent of the instant invention may also be constructed such that either strand of the dsRNA agent independently targets two or more regions of α-1 antitrypsin RNA, or such that one of the strands of the dsRNA agent targets a cellular target gene of α-1 antitrypsin known in the art.

Use of multifunctional dsRNA molecules that target more then one region of a target nucleic acid molecule can also provide potent inhibition of α-1 antitrypsin RNA levels and expression. For example, a single multifunctional dsRNA construct of the invention can target both the α-1 antitrypsin-506 and α-1 antitrypsin-1059 sites simultaneously; additionally and/or alternatively, single or multifunctional agents of the invention can be designed to selectively target one splice variant of α-1 antitrypsin over another.

Thus, the dsRNA agents of the instant invention, individually, or in combination or in conjunction with other drugs, can be used to treat, inhibit, reduce, or prevent a α-1 antitrypsin-associated disease or disorder. For example, the dsRNA molecules can be administered to a subject or can be administered to other appropriate cells evident to those skilled in the art, individually or in combination with one or more drugs under conditions suitable for the treatment.

The dsRNA molecules also can be used in combination with other known treatments to treat, inhibit, reduce, or prevent a α-1 antitrypsin-associated disease or disorder in a subject or organism. For example, the described molecules could be used in combination with one or more known compounds, treatments, or procedures to treat, inhibit, reduce, or prevent a α-1 antitrypsin-associated disease or disorder in a subject or organism as are known in the art.

A dsRNA agent of the invention can be conjugated (e.g., at its 5' or 3' terminus of its sense or antisense strand) or unconjugated to another moiety (e.g. a non-nucleic acid moiety such as a peptide), an organic compound (e.g., a dye, cholesterol, or the like). Modifying dsRNA agents in this way may improve cellular uptake or enhance cellular targeting activities of the resulting dsRNA agent derivative as compared to the corresponding unconjugated dsRNA agent, are useful for tracing the dsRNA agent derivative in the cell, or improve the stability of the dsRNA agent derivative compared to the corresponding unconjugated dsRNA agent.

Methods of Introducing Nucleic Acids, Vectors, and Host Cells dsRNA agents of the invention may be directly introduced into a cell (i.e., intracellularly); or introduced extracellularly into a cavity, interstitial space, into the circulation of an organism, introduced orally, or may be introduced by bathing a cell or organism in a solution containing the nucleic acid. Vascular or extravascular circulation, the blood or lymph system, and the cerebrospinal fluid are sites where the nucleic acid may be introduced.

The dsRNA agents of the invention can be introduced using nucleic acid delivery methods known in art including injection of a solution containing the nucleic acid, bombardment by particles covered by the nucleic acid, soaking the cell or organism in a solution of the nucleic acid, or electroporation of cell membranes in the presence of the nucleic acid. Other methods known in the art for introducing nucleic acids to cells may be used, such as lipid-mediated carrier transport, chemical-mediated transport, and cationic liposome transfection such as calcium phosphate, and the like. The nucleic acid may be introduced along with other components that perform one or more of the following activities: enhance nucleic acid uptake by the cell or otherwise increase inhibition of the target α-1 antitrypsin RNA.

A cell having a target α-1 antitrypsin RNA may be from the germ line or somatic, totipotent or pluripotent, dividing or non-dividing, parenchyma or epithelium, immortalized or transformed, or the like. The cell may be a stem cell or a differentiated cell. Cell types that are differentiated include adipocytes, fibroblasts, myocytes, cardiomyocytes, endothelium, neurons, glia, blood cells, megakaryocytes, lymphocytes, macrophages, neutrophils, eosinophils, basophils, mast cells, leukocytes, granulocytes, keratinocytes, chondrocytes, osteoblasts, osteoclasts, hepatocytes, and cells of the endocrine or exocrine glands.

Depending on the particular target α-1 antitrypsin RNA sequence and the dose of dsRNA agent material delivered, this process may provide partial or complete loss of function for the α-1 antitrypsin RNA. A reduction or loss of RNA levels or expression (either α-1 antitrypsin RNA expression or encoded polypeptide expression) in at least 50%, 60%, 70%, 80%, 90%, 95% or 99% or more of targeted cells is exemplary. Inhibition of α-1 antitrypsin RNA levels or expression refers to the absence (or observable decrease) in the level of α-1 antitrypsin RNA or α-1 antitrypsin RNA-encoded protein. Specificity refers to the ability to inhibit the α-1 antitrypsin RNA without manifest effects on other genes of the cell. The consequences of inhibition can be confirmed by examination of the outward properties of the cell or organism or by biochemical techniques such as RNA solution hybridization, nuclease protection, Northern hybridization, reverse transcription, gene expression monitoring with a microarray, antibody binding, enzyme linked immunosorbent assay (ELISA), Western blotting, radioimmunoassay (RIA), other immunoassays, and fluorescence activated cell analysis (FACS). Inhibition of target α-1 antitrypsin RNA sequence(s) by the dsRNA agents of the invention also can be measured based upon the effect of administration of such dsRNA agents upon development/progression of an α-1 antitrypsin-associated disease or disorder, e.g., chronic liver disease, liver inflammation, cirrhosis, liver fibrosis, and/or hepatocellular carcinoma, etc., either in vivo or in vitro. Treatment of any of these preceding liver conditions can be assessed by art-recognized tests for liver function, e.g., determination of the percentage of liver function (e.g., 20%, 30%, 40%, 50%, 60%, 70%, 80% or greater) that is being achieved relative to average healthy liver function of an appropriate control population. In certain embodiments, successful treatment result in a decline or halting of reduction in total liver function associated with a liver disease. In some embodiments, liver function improves with successful treatment. Treatment and/or reductions in hepatocellular carcinoma tumor or cancer cell levels can include halting or reduction of growth of tumor or cancer cell levels or reductions of, e.g., 10%, 20%, 30%, 40%, 50%, 60%, 70%, 80%, 90%, 95% or 99% or more, and can also be measured in logarithmic terms, e.g., 10-fold, 100-fold, 1000-fold, $10^5$-fold, $10^6$-fold, $10^7$-fold reduction in cancer cell levels could be achieved via administration of the dsRNA agents of the invention to cells, a tissue, or a subject.

For RNA-mediated inhibition in a cell line or whole organism, expression a reporter or drug resistance gene whose protein product is easily assayed can be measured. Such reporter genes include acetohydroxyacid synthase (AHAS), alkaline phosphatase (AP), beta galactosidase (LacZ), beta glucoronidase (GUS), chloramphenicol acetyltransferase (CAT), green fluorescent protein (GFP), horseradish peroxidase (HRP), luciferase (Luc), nopaline synthase (NOS), octopine synthase (OCS), and derivatives thereof. Multiple selectable markers are available that confer resistance to ampicillin, bleomycin, chloramphenicol, gentamycin, hygromycin, kanamycin, lincomycin, methotrexate, phosphinothricin, puromycin, and tetracyclin. Depending on the assay, quantitation of the amount of gene expression allows one to determine a degree of inhibition which is greater than 10%, 33%, 50%, 90%, 95% or 99% as compared to a cell not treated according to the present invention.

Lower doses of injected material and longer times after administration of RNA silencing agent may result in inhibition in a smaller fraction of cells (e.g., at least 10%, 20%, 50%, 75%, 90%, or 95% of targeted cells). Quantitation of gene expression in a cell may show similar amounts of inhibition at the level of accumulation of target α-1 antitrypsin RNA or translation of target protein. As an example, the efficiency of inhibition may be determined by assessing the amount of gene product in the cell; RNA may be detected with a hybridization probe having a nucleotide sequence outside the region used for the inhibitory dsRNA, or translated polypeptide may be detected with an antibody raised against the polypeptide sequence of that region.

The dsRNA agent may be introduced in an amount which allows delivery of at least one copy per cell. Higher doses (e.g., at least 5, 10, 100, 500 or 1000 copies per cell) of material may yield more effective inhibition; lower doses may also be useful for specific applications.

Pharmaceutical Compositions

In certain embodiments, the present invention provides for a pharmaceutical composition comprising the dsRNA agent of the present invention. The dsRNA agent sample can be suitably formulated and introduced into the environment of the cell by any means that allows for a sufficient portion of the sample to enter the cell to induce gene silencing, if it is to occur. Many formulations for dsRNA are known in the art and can be used so long as the dsRNA gains entry to the target cells so that it can act. See, e.g., U.S. published patent application Nos. 2004/0203145 A1 and 2005/0054598 A1. For example, the dsRNA agent of the instant invention can be formulated in buffer solutions such as phosphate buffered saline solutions, liposomes, micellar structures, and capsids. Formulations of dsRNA agent with cationic lipids can be used to facilitate transfection of the dsRNA agent into cells. For example, cationic lipids, such as lipofectin (U.S. Pat. No. 5,705,188), cationic glycerol derivatives, and polycationic molecules, such as polylysine (published PCT International Application WO 97/30731), can be used. Suitable lipids include Oligofectamine, Lipofectamine (Life Technologies), NC388 (Ribozyme Pharmaceuticals, Inc., Boulder, Colo.), or FuGene 6 (Roche) all of which can be used according to the manufacturer's instructions.

Such compositions typically include the nucleic acid molecule and a pharmaceutically acceptable carrier. As used herein the language "pharmaceutically acceptable carrier" includes saline, solvents, dispersion media, coatings, antibacterial and antifungal agents, isotonic and absorption delaying agents, and the like, compatible with pharmaceutical administration. Supplementary active compounds can also be incorporated into the compositions.

A pharmaceutical composition is formulated to be compatible with its intended route of administration. Examples of routes of administration include parenteral, e.g., intravenous, intradermal, subcutaneous, oral (e.g., inhalation), transdermal (topical), transmucosal, and rectal administration. Solutions or suspensions used for parenteral, intradermal, or subcutaneous application can include the following components: a sterile diluent such as water for injection, saline solution, fixed oils, polyethylene glycols, glycerine, propylene glycol or other synthetic solvents; antibacterial agents such as benzyl alcohol or methyl parabens; antioxidants such as ascorbic acid or sodium bisulfite; chelating agents such as ethylenediaminetetraacetic acid; buffers such as acetates, citrates or phosphates and agents for the adjustment of tonicity such as sodium chloride or dextrose. pH can be adjusted with acids or bases, such as hydrochloric acid or sodium hydroxide. The parenteral preparation can be enclosed in ampoules, disposable syringes or multiple dose vials made of glass or plastic.

Pharmaceutical compositions suitable for injectable use include sterile aqueous solutions (where water soluble) or dispersions and sterile powders for the extemporaneous preparation of sterile injectable solutions or dispersion. For intravenous administration, suitable carriers include physiological saline, bacteriostatic water, Cremophor EL™ (BASF, Parsippany, N.J.) or phosphate buffered saline (PBS). In all cases, the composition must be sterile and should be fluid to the extent that easy syringability exists. It should be stable under the conditions of manufacture and storage and must be preserved against the contaminating action of microorganisms such as bacteria and fungi. The carrier can be a solvent or dispersion medium containing, for example, water, ethanol, polyol (for example, glycerol, propylene glycol, and liquid polyetheylene glycol, and the like), and suitable mixtures thereof. The proper fluidity can be maintained, for example, by the use of a coating such as lecithin, by the maintenance of the required particle size in the case of dispersion and by the use of surfactants. Prevention of the action of microorganisms can be achieved by various antibacterial and antifungal agents, for example, parabens, chlorobutanol, phenol, ascorbic acid, thimerosal, and the like. In many cases, it will be preferable to include isotonic agents, for example, sugars, polyalcohols such as manitol, sorbitol, sodium chloride in the composition. Prolonged absorption of the injectable compositions can be brought about by including in the composition an agent which delays absorption, for example, aluminum monostearate and gelatin.

Sterile injectable solutions can be prepared by incorporating the active compound in the required amount in a selected solvent with one or a combination of ingredients enumerated above, as required, followed by filtered sterilization. Generally, dispersions are prepared by incorporating the active compound into a sterile vehicle, which contains a basic dispersion medium and the required other ingredients from those enumerated above. In the case of sterile powders for the preparation of sterile injectable solutions, the preferred methods of preparation are vacuum drying and freeze-drying which yields a powder of the active ingredient plus any additional desired ingredient from a previously sterile-filtered solution thereof.

Oral compositions generally include an inert diluent or an edible carrier. For the purpose of oral therapeutic administration, the active compound can be incorporated with excipients and used in the form of tablets, troches, or capsules, e.g., gelatin capsules. Oral compositions can also be prepared using a fluid carrier for use as a mouthwash. Pharmaceutically compatible binding agents, and/or adjuvant materials can be included as part of the composition. The tablets, pills, capsules, troches and the like can contain any of the following ingredients, or compounds of a similar nature: a binder such as microcrystalline cellulose, gum tragacanth or gelatin; an excipient such as starch or lactose, a disintegrating agent such as alginic acid, Primogel, or corn starch; a lubricant such as magnesium stearate or Sterotes; a glidant such as colloidal silicon dioxide; a sweetening agent such as sucrose or saccharin; or a flavoring agent such as peppermint, methyl salicylate, or orange flavoring.

For administration by inhalation, the compounds are delivered in the form of an aerosol spray from pressured container or dispenser which contains a suitable propellant, e.g., a gas such as carbon dioxide, or a nebulizer. Such methods include those described in U.S. Pat. No. 6,468,798.

Systemic administration can also be by transmucosal or transdermal means. For transmucosal or transdermal administration, penetrants appropriate to the barrier to be permeated are used in the formulation. Such penetrants are generally known in the art, and include, for example, for transmucosal administration, detergents, bile salts, and fusidic acid derivatives. Transmucosal administration can be accomplished through the use of nasal sprays or suppositories. For transdermal administration, the active compounds are formulated into ointments, salves, gels, or creams as generally known in the art.

The compounds can also be prepared in the form of suppositories (e.g., with conventional suppository bases such as cocoa butter and other glycerides) or retention enemas for rectal delivery.

The compounds can also be administered by transfection or infection using methods known in the art, including but not limited to the methods described in McCaffrey et al. (2002), Nature, 418(6893), 38-9 (hydrodynamic transfection); Xia et al. (2002), Nature Biotechnol., 20(10), 1006-10 (viral-mediated delivery); or Putnam (1996), Am. J. Health Syst. Pharm. 53(2), 151-160, erratum at Am. J. Health Syst. Pharm. 53(3), 325 (1996).

The compounds can also be administered by a method suitable for administration of nucleic acid agents, such as a DNA vaccine. These methods include gene guns, bio injectors, and skin patches as well as needle-free methods such as the micro-particle DNA vaccine technology disclosed in U.S. Pat. No. 6,194,389, and the mammalian transdermal needle-free vaccination with powder-form vaccine as disclosed in U.S. Pat. No. 6,168,587. Additionally, intranasal delivery is possible, as described in, inter alia, Hamajima et al. (1998), Clin. Immunol. Immunopathol., 88(2), 205-10. Liposomes (e.g., as described in U.S. Pat. No. 6,472,375) and microencapsulation can also be used. Biodegradable targetable microparticle delivery systems can also be used (e.g., as described in U.S. Pat. No. 6,471,996).

In one embodiment, the active compounds are prepared with carriers that will protect the compound against rapid elimination from the body, such as a controlled release formulation, including implants and microencapsulated delivery systems. Biodegradable, biocompatible polymers can be used, such as ethylene vinyl acetate, polyanhydrides, polyglycolic acid, collagen, polyorthoesters, and polylactic acid. Such formulations can be prepared using standard techniques. The materials can also be obtained commercially from Alza Corporation and Nova Pharmaceuticals, Inc. Liposomal suspensions (including liposomes targeted to infected cells with monoclonal antibodies to viral antigens) can also be used as pharmaceutically acceptable carriers. These can be prepared according to methods known to those skilled in the art, for example, as described in U.S. Pat. No. 4,522,811.

Toxicity and therapeutic efficacy of such compounds can be determined by standard pharmaceutical procedures in cell cultures or experimental animals, e.g., for determining the $LD_{50}$ (the dose lethal to 50% of the population) and the $ED_{50}$ (the dose therapeutically effective in 50% of the population). The dose ratio between toxic and therapeutic effects is the therapeutic index and it can be expressed as the ratio $LD_{50}/ED_{50}$. Compounds which exhibit high therapeutic indices are preferred. While compounds that exhibit toxic side effects may be used, care should be taken to design a delivery system that targets such compounds to the site of affected tissue in order to minimize potential damage to uninfected cells and, thereby, reduce side effects.

The data obtained from the cell culture assays and animal studies can be used in formulating a range of dosage for use in humans. The dosage of such compounds lies preferably within a range of circulating concentrations that include the $ED_{50}$ with little or no toxicity. The dosage may vary within this range depending upon the dosage form employed and the route of administration utilized. For a compound used in the method of the invention, the therapeutically effective dose can be estimated initially from cell culture assays. A dose may be formulated in animal models to achieve a circulating plasma concentration range that includes the $IC_{50}$ (i.e., the concentration of the test compound which achieves a half-maximal inhibition of symptoms) as determined in cell culture. Such information can be used to more accurately determine useful doses in humans. Levels in plasma may be measured, for example, by high performance liquid chromatography.

As defined herein, a therapeutically effective amount of a nucleic acid molecule (i.e., an effective dosage) depends on the nucleic acid selected. For instance, single dose amounts of a dsRNA (or, e.g., a construct(s) encoding for such dsRNA) in the range of approximately 1 pg to 1000 mg may be administered; in some embodiments, 10, 30, 100, or 1000 pg, or 10, 30, 100, or 1000 ng, or 10, 30, 100, or 1000 µg, or 10, 30, 100, or 1000 mg may be administered. In some embodiments, 1-5 g of the compositions can be administered. The compositions can be administered one from one or more times per day to one or more times per week; including once every other day. The skilled artisan will appreciate that certain factors may influence the dosage and timing required to effectively treat a subject, including but not limited to the severity of the disease or disorder, previous treatments, the general health and/or age of the subject, and other diseases present. Moreover, treatment of a subject with a therapeutically effective amount of a nucleic acid (e.g., dsRNA), protein, polypeptide, or antibody can include a single treatment or, preferably, can include a series of treatments.

The nucleic acid molecules of the invention can be inserted into expression constructs, e.g., viral vectors, retroviral vectors, expression cassettes, or plasmid viral vectors, e.g., using methods known in the art, including but not limited to those described in Xia et al., (2002), supra. Expression constructs can be delivered to a subject by, for example, inhalation, orally, intravenous injection, local administration (see U.S. Pat. No. 5,328,470) or by stereotactic injection (see e.g., Chen et al. (1994), Proc. Natl. Acad. Sci. USA, 91, 3054-3057). The pharmaceutical preparation of the delivery vector can include the vector in an acceptable diluent, or can comprise a slow release matrix in which the delivery vehicle is imbedded. Alternatively, where the complete delivery vector can be produced intact from recombinant cells, e.g., retroviral vectors, the pharmaceutical preparation can include one or more cells which produce the gene delivery system.

The expression constructs may be constructs suitable for use in the appropriate expression system and include, but are not limited to retroviral vectors, linear expression cassettes, plasmids and viral or virally-derived vectors, as known in the art. Such expression constructs may include one or more inducible promoters, RNA Pol III promoter systems such as U6 snRNA promoters or H1 RNA polymerase III promoters, or other promoters known in the art. The constructs can include one or both strands of the siRNA. Expression constructs expressing both strands can also include loop structures linking both strands, or each strand can be separately transcribed from separate promoters within the same construct. Each strand can also be transcribed from a separate expression construct, e.g., Tuschl (2002, *Nature Biotechnol* 20: 500-505).

It can be appreciated that the method of introducing dsRNA agents into the environment of the cell will depend on the type of cell and the make up of its environment. For example, when the cells are found within a liquid, one preferable formulation is with a lipid formulation such as in lipofectamine and the dsRNA agents can be added directly to the liquid environment of the cells. Lipid formulations can also be administered to animals such as by intravenous, intramuscular, or intraperitoneal injection, or orally or by inhalation or other methods as are known in the art. When the formulation is suitable for administration into animals such as mammals and more specifically humans, the formulation is also pharmaceutically acceptable. Pharmaceutically acceptable formulations for administering oligonucleotides are known and can be used. In some instances, it may be preferable to formulate dsRNA agents in a buffer or saline solution and directly inject the formulated dsRNA agents into cells, as in studies with oocytes. The direct injection of dsRNA agent duplexes may also be done. For suitable methods of introducing dsRNA (e.g., DsiRNA agents), see U.S. published patent application No. 2004/0203145 A1.

Suitable amounts of a dsRNA agent must be introduced and these amounts can be empirically determined using standard methods. Typically, effective concentrations of individual dsRNA agent species in the environment of a cell will be 50 nanomolar or less, 10 nanomolar or less, or compositions in which concentrations of 1 nanomolar or less can be used. In another embodiment, methods utilizing a concentration of 200 picomolar or less, 100 picomolar or less, 50 picomolar or less, 20 picomolar or less, and even a concentration of 10 picomolar or less, 5 picomolar or less, 2 picomolar or less or 1 picomolar or less can be used in many circumstances.

The method can be carried out by addition of the dsRNA agent compositions to an extracellular matrix in which cells can live provided that the dsRNA agent composition is formulated so that a sufficient amount of the dsRNA agent can enter the cell to exert its effect. For example, the method is amenable for use with cells present in a liquid such as a liquid culture or cell growth media, in tissue explants, or in whole organisms, including animals, such as mammals and especially humans.

The level or activity of a α-1 antitrypsin RNA can be determined by a suitable method now known in the art or that is later developed. It can be appreciated that the method used to measure a target RNA and/or the expression of a target RNA can depend upon the nature of the target RNA. For example, where the target α-1 antitrypsin RNA sequence encodes a protein, the term "expression" can refer to a protein or the α-1 antitrypsin RNA/transcript derived from the α-1 antitrypsin gene (either genomic or of exogenous origin). In such instances the expression of the target α-1 antitrypsin RNA can be determined by measuring the amount of α-1 antitrypsin RNA/transcript directly or by measuring the amount of α-1 antitrypsin protein. Protein can be measured in protein assays such as by staining or immunoblotting or, if the protein catalyzes a reaction that can be measured, by measuring reaction rates. All such methods are known in the art and can be used. Where target α-1 antitrypsin RNA levels are to be measured, art-recognized methods for detecting RNA levels can be used (e.g., RT-PCR, Northern Blotting, etc.). In targeting α-1 antitrypsin RNAs with the dsRNA agents of the instant invention, it is also anticipated that measurement of the efficacy of a dsRNA agent in reducing levels of α-1 antitrypsin RNA or protein in a subject, tissue, in cells, either in vitro or in vivo, or in cell extracts can also be used to determine the extent of reduction of α-1 antitrypsin-associated phenotypes (e.g., disease or disorders, e.g., chronic liver disease, liver inflammation, cirrhosis, liver fibrosis, and/or hepatocellular carcinoma, etc.). The above measurements can be made on cells, cell extracts, tissues, tissue extracts or other suitable source material.

The determination of whether the expression of a α-1 antitrypsin RNA has been reduced can be by a suitable method that can reliably detect changes in RNA levels. Typically, the determination is made by introducing into the environment of a cell undigested dsRNA such that at least a portion of that dsRNA agent enters the cytoplasm, and then measuring the level of the target RNA. The same measurement is made on identical untreated cells and the results obtained from each measurement are compared.

The dsRNA agent can be formulated as a pharmaceutical composition which comprises a pharmacologically effective amount of a dsRNA agent and pharmaceutically acceptable carrier. A pharmacologically or therapeutically effective amount refers to that amount of a dsRNA agent effective to produce the intended pharmacological, therapeutic or preventive result. The phrases "pharmacologically effective amount" and "therapeutically effective amount" or simply "effective amount" refer to that amount of an RNA effective to produce the intended pharmacological, therapeutic or preventive result. For example, if a given clinical treatment is considered effective when there is at least a 20% reduction in a measurable parameter associated with a disease or disorder, a therapeutically effective amount of a drug for the treatment of that disease or disorder is the amount necessary to effect at least a 20% reduction in that parameter.

Suitably formulated pharmaceutical compositions of this invention can be administered by means known in the art such as by parenteral routes, including intravenous, intramuscular, intraperitoneal, subcutaneous, transdermal, airway (aerosol), rectal, vaginal and topical (including buccal and sublingual) administration. In some embodiments, the pharmaceutical compositions are administered by intravenous or intraparenteral infusion or injection.

In general, a suitable dosage unit of dsRNA will be in the range of 0.001 to 0.25 milligrams per kilogram body weight of the recipient per day, or in the range of 0.01 to 20 micrograms per kilogram body weight per day, or in the range of 0.001 to 5 micrograms per kilogram of body weight per day, or in the range of 1 to 500 nanograms per kilogram of body weight per day, or in the range of 0.01 to 10 micrograms per kilogram body weight per day, or in the range of 0.10 to 5 micrograms per kilogram body weight per day, or in the range of 0.1 to 2.5 micrograms per kilogram body weight per day. A pharmaceutical composition comprising the dsRNA can be administered once daily. However, the therapeutic agent may also be dosed in dosage units containing two, three, four, five, six or more sub-doses administered at appropriate intervals throughout the day. In that case, the dsRNA contained in each sub-dose must be correspondingly smaller in order to achieve the total daily dosage unit. The dosage unit can also be compounded for a single dose over several days, e.g., using a conventional sustained release formulation which provides sustained and consistent release of the dsRNA over a several day period. Sustained release formulations are well known in the art. In this embodiment, the dosage unit contains a corresponding multiple of the daily dose. Regardless of the formulation, the pharmaceutical composition must contain dsRNA in a quantity sufficient to inhibit expression of the target gene in the animal or human being treated. The composition can be compounded in such a way that the sum of the multiple units of dsRNA together contain a sufficient dose.

Data can be obtained from cell culture assays and animal studies to formulate a suitable dosage range for humans. The dosage of compositions of the invention lies within a range of circulating concentrations that include the $ED_{50}$ (as determined by known methods) with little or no toxicity. The dosage may vary within this range depending upon the dosage form employed and the route of administration utilized. For a compound used in the method of the invention, the therapeutically effective dose can be estimated initially from cell culture assays. A dose may be formulated in animal models to achieve a circulating plasma concentration range of the compound that includes the $IC_{50}$ (i.e., the concentration of the test compound which achieves a half-maximal inhibition of symptoms) as determined in cell culture. Such information can be used to more accurately determine useful doses in humans. Levels of dsRNA in plasma may be measured by standard methods, for example, by high performance liquid chromatography.

The pharmaceutical compositions can be included in a kit, container, pack, or dispenser together with instructions for administration.

Methods of Treatment

The present invention provides for both prophylactic and therapeutic methods of treating a subject at risk of (or susceptible to) a disease or disorder caused, in whole or in part, by α-1 antitrypsin (e.g., misregulation and/or elevation of α-1 antitrypsin transcript and/or α-1 antitrypsin protein levels), or treatable via selective targeting of α-1 antitrypsin.

In certain aspects, the invention provides a method for preventing in a subject, a disease or disorder as described herein (including, e.g., prevention of the commencement of transforming events within a subject via inhibition of α-1 antitrypsin expression), by administering to the subject a therapeutic agent (e.g., a dsRNA agent or vector or transgene encoding same). Subjects at risk for the disease can be identified by, for example, one or a combination of diagnostic or prognostic assays as described herein. Administration of a prophylactic agent can occur prior to the detection of, e.g., cancer in a subject, or the manifestation of symptoms characteristic of the disease or disorder, such that the disease or disorder is prevented or, alternatively, delayed in its progression.

Another aspect of the invention pertains to methods of treating subjects therapeutically, i.e., altering the onset of symptoms of the disease or disorder. These methods can be performed in vitro (e.g., by culturing the cell with the dsRNA agent) or, alternatively, in vivo (e.g., by administering the dsRNA agent to a subject).

With regard to both prophylactic and therapeutic methods of treatment, such treatments may be specifically tailored or modified, based on knowledge obtained from the field of pharmacogenomics. "Pharmacogenomics", as used herein, refers to the application of genomics technologies such as gene sequencing, statistical genetics, and gene expression analysis to drugs in clinical development and on the market. More specifically, the term refers the study of how a patient's genes determine his or her response to a drug (e.g., a patient's "drug response phenotype", or "drug response genotype"). Thus, another aspect of the invention provides methods for tailoring an individual's prophylactic or therapeutic treatment with either the target α-1 antitrypsin RNA molecules of the present invention or target α-1 antitrypsin RNA modulators according to that individual's drug response genotype. Pharmacogenomics allows a clinician or physician to target prophylactic or therapeutic treatments to patients who will most benefit from the treatment and to avoid treatment of patients who will experience toxic drug-related side effects.

The practice of the present invention employs, unless otherwise indicated, conventional techniques of chemistry, molecular biology, microbiology, recombinant DNA, genetics, immunology, cell biology, cell culture and transgenic biology, which are within the skill of the art. See, e.g., Maniatis et al., 1982, Molecular Cloning (Cold Spring Harbor Laboratory Press, Cold Spring Harbor, N.Y.); Sambrook et al., 1989, Molecular Cloning, 2nd Ed. (Cold Spring Harbor Laboratory Press, Cold Spring Harbor, N.Y.); Sambrook and Russell, 2001, Molecular Cloning, 3rd Ed. (Cold Spring Harbor Laboratory Press, Cold Spring Harbor, N.Y.); Ausubel et al., 1992), Current Protocols in Molecular Biology (John Wiley & Sons, including periodic updates); Glover, 1985, DNA Cloning (IRL Press, Oxford); Anand, 1992; Guthrie and Fink, 1991; Harlow and Lane, 1988, Antibodies, (Cold Spring Harbor Laboratory Press, Cold Spring Harbor, N.Y.); Jakoby and Pastan, 1979; Nucleic Acid Hybridization (B. D. Hames & S. J. Higgins eds. 1984); Transcription And Translation (B. D. Hames & S. J. Higgins eds. 1984); Culture Of Animal Cells (R. I. Freshney, Alan R. Liss, Inc., 1987); Immobilized Cells And Enzymes (IRL Press, 1986); B. Perbal, A Practical Guide To Molecular Cloning (1984); the treatise, Methods In Enzymology (Academic Press, Inc., N.Y.); Gene Transfer Vectors For Mammalian Cells (J. H. Miller and M. P. Calos eds., 1987, Cold Spring Harbor Laboratory); Methods In Enzymology, Vols. 154 and 155 (Wu et al. eds.), Immunochemical Methods In Cell And Molecular Biology (Mayer and Walker, eds., Academic Press, London, 1987); Handbook Of Experimental Immunology, Volumes I-IV (D. M. Weir and C. C. Blackwell, eds., 1986); Riott, Essential Immunology, 6th Edition, Blackwell Scientific Publications, Oxford, 1988; Hogan et al., Manipulating the Mouse Embryo, (Cold Spring Harbor Laboratory Press, Cold Spring Harbor, N.Y., 1986); Westerfield, M., The zebrafish book. A guide for the laboratory use of zebrafish (Danio rerio), (4th Ed., Univ. of Oregon Press, Eugene, 2000).

Unless otherwise defined, all technical and scientific terms used herein have the same meaning as commonly understood by one of ordinary skill in the art to which this invention belongs. Although methods and materials similar or equivalent to those described herein can be used in the practice or testing of the present invention, suitable methods and materials are described below. All publications, patent applications, patents, and other references mentioned herein are incorporated by reference in their entirety. In case of conflict, the present specification, including definitions, will control. In addition, the materials, methods, and examples are illustrative only and not intended to be limiting.

EXAMPLES

The present invention is described by reference to the following Examples, which are offered by way of illustration and are not intended to limit the invention in any manner. Standard techniques well known in the art or the techniques specifically described below were utilized.

Example 1

Preparation of Double-Stranded RNA Oligonucleotides

Oligonucleotide Synthesis and Purification

DsiRNA molecules can be designed to interact with various sites in the RNA message, for example, target sequences within the RNA sequences described herein. In presently exemplified agents, 384 human target α-1 antitrypsin sequences were selected for evaluation (a selection of the 384 human target α-1 antitrypsin sites were predicted to be conserved with corresponding sites in the mouse α-1 antitrypsin transcript sequence). The sequences of one strand of the DsiRNA molecules were complementary to the target α-1 antitrypsin site sequences described above. The DsiRNA molecules were chemically synthesized using methods described herein. Generally, DsiRNA constructs were synthesized using solid phase oligonucleotide synthesis methods as described for 19-23mer siRNAs (see for example Usman et al., U.S. Pat. Nos. 5,804,683; 5,831,071; 5,998,203; 6,117,657; 6,353,098; 6,362,323; 6,437,117; 6,469,158; Scaringe et al., U.S. Pat. Nos. 6,111,086; 6,008,400; 6,111,086).

Individual RNA strands were synthesized and HPLC purified according to standard methods (Integrated DNA Technologies, Coralville, Iowa). For example, RNA oligonucleotides were synthesized using solid phase phosphoramidite chemistry, deprotected and desalted on NAP-5 columns (Amersham Pharmacia Biotech, Piscataway, N.J.) using standard techniques (Damha and Olgivie, 1993, *Methods Mol Biol* 20: 81-114; Wincott et al., 1995, *Nucleic Acids Res* 23: 2677-84). The oligomers were purified using ion-exchange high performance liquid chromatography (IE-HPLC) on an Amersham Source 15Q column (1.0 cm×25 cm; Amersham Pharmacia Biotech, Piscataway, N.J.) using a 15 min step-linear gradient. The gradient varied from 90:10 Buffers A:B to 52:48 Buffers A:B, where Buffer A was 100 mM Tris pH 8.5 and Buffer B was 100 mM Tris pH 8.5, 1 M NaCl. Samples were monitored at 260 nm and peaks corresponding to the full-length oligonucleotide species were collected, pooled, desalted on NAP-5 columns, and lyophilized.

The purity of each oligomer was determined by capillary electrophoresis (CE) on a Beckman PACE 5000 (Beckman Coulter, Inc., Fullerton, Calif.). The CE capillaries had a 100 μm inner diameter and contained ssDNA 100R Gel (Beckman-Coulter). Typically, about 0.6 nmole of oligonucleotide was injected into a capillary, run in an electric field of 444 V/cm and detected by UV absorbance at 260 nm. Denaturing Tris-Borate-7 M-urea running buffer was purchased from Beckman-Coulter. Oligoribonucleotides were obtained that were at least 90% pure as assessed by CE for use in experiments described below. Compound identity was verified by matrix-assisted laser desorption ionization time-of-flight (MALDI-TOF) mass spectroscopy on a Voyager DE™ Biospectometry Work Station (Applied Biosystems, Foster City, Calif.) following the manufacturer's recommended protocol. Relative molecular masses of all oligomers were obtained, often within 0.2% of expected molecular mass.

Preparation of Duplexes

Single-stranded RNA (ssRNA) oligomers were resuspended, e.g., at 100 μM concentration in duplex buffer consisting of 100 mM potassium acetate, 30 mM HEPES, pH 7.5. Complementary sense and antisense strands were mixed in equal molar amounts to yield a final solution of, e.g., 50 μM duplex. Samples were heated to 100° C. for 5' in RNA buffer (IDT) and allowed to cool to room temperature before use. Double-stranded RNA (dsRNA) oligomers were stored at −20° C. Single-stranded RNA oligomers were stored lyophilized or in nuclease-free water at −80° C.

Nomenclature

For consistency, the following nomenclature has been employed in the instant specification. Names given to duplexes indicate the length of the oligomers and the presence or absence of overhangs. A "25/27" is an asymmetric duplex having a 25 base sense strand and a 27 base antisense strand with a 2-base 3'-overhang. A "27/25" is an asymmetric duplex having a 27 base sense strand and a 25 base antisense strand.

Cell Culture and RNA Transfection

Huh7 cells were obtained and maintained in DMEM (HyClone) supplemented with 10% fetal bovine serum (HyClone) at 37° C. under 5% $CO_2$. For RNA transfections, cells were transfected with DsiRNAs at a final concentration of 1 nM, 0.1 nM or 0.03 nM using Lipofectamine™ RNAiMAX (Invitrogen) and following manufacturer's instructions. Briefly, for 0.1 nM transfections, e.g., of Example 3 below, an aliquot of stock solution of each DsiRNA was mixed with Opti-MEM I (Invitrogen) and Lipofectamine™ RNAiMAX to reach a volume of 150 μL (with 0.3 nM DsiRNA). The resulting 150 μL mix was incubated for 20 min at RT to allow DsiRNA:Lipofectamine™ RNAiMAX complexes to form. Meanwhile, target cells were trypsinized and resuspended in medium. At the end of the 20 min of complexation, 50 uL of the DsiRNA:RNAiMAX mixture was added per well into triplicate wells of 96 well plates. Finally, 100 μL of the cell suspension was added to each well (final volume 150 μL) and plates were placed into the incubator for 24 hours.

Assessment of α-1 Antitrypsin Inhibition

α-1 antitrypsin target gene knockdown was determined by qRT-PCR, with values normalized to HPRT and SFRS9 housekeeping genes, and to transfections with control DsiRNAs and/or mock transfection controls.

RNA Isolation and Analysis

Media was aspirated, and total RNA was extracted using the SV96 kit (Promega). Total RNA was reverse-transcribed using SuperscriptII, Oligo dT, and random hexamers following manufacturer's instructions. Typically, the resulting cDNA was analyzed by qPCR using primers and probes specific for both the α-1 antitrypsin gene and for the human genes HPRT-1 and SFRS9. An ABI 7700 was used for the amplification reactions. Each sample was tested in triplicate. Relative α-1 antitrypsin RNA levels were normalized to HPRT1 and SFRS9 RNA levels and compared with RNA levels obtained in transfection control samples.

Example 2

DsiRNA Inhibition of α-1 Antitrypsin

DsiRNA molecules targeting α-1 antitrypsin were designed and synthesized as described above and tested in human Huh7 cells (alternatively, HepG2 or other human cells could have been used) for inhibitory efficacy. For transfection, annealed DsiRNAs were mixed with the transfection reagent (Lipofectamine™ RNAiMAX, Invitrogen) and incubated for 20 minutes at room temperature. The Huh7 (human) or AML12 (mouse) cells (alternatively, mouse Hepa 1-6 or other mouse cells could have been used) were trypsinized, resuspended in media, and added to wells (100 uL per well) to give a final DsiRNA concentration of 1 nM in a volume of 150 μl. Each DsiRNA transfection mixture was added to 3 wells for triplicate DsiRNA treatments. Cells were incubated at 37° C. for 24 hours in the continued presence of the DsiRNA transfection mixture. At 24 hours, RNA was prepared from each well of treated cells. The supernatants with the transfection mixtures were first removed and discarded, then the cells were lysed and RNA was prepared from each well. Target α-1 antitrypsin RNA levels following treatment were evaluated by qRT-PCR for the α-1 antitrypsin target gene, with values normalized to those obtained for controls. Triplicate data was averaged and the % error was determined for each treatment. Normalized data were both tabulated and graphed, and the reduction of target mRNA by active DsiRNAs in comparison to controls was determined (see Table 22 below and FIGS. 2A to 2D).

TABLE 22

α-1 Antitrypsin Inhibitory Efficacy of DsiRNAs Assayed at 1 nM in Human Huh7 and Mouse AML12 Cells

| | | | Human - Huh7 Normalized HPRT/SFRS9; vs NC1, NC5, NC7 | | Mouse - AML12 Normalized HPRT/Rpl23; vs NC1, NC5, NC7 | |
|---|---|---|---|---|---|---|
| Duplex Name | Mm Location | Rhesus Location | Hs 462-563 (FAM) Assay % Remaining | Hs 1811-1910 (HEX) Assay % Remaining | Mm 331-462 (FAM) Assay % Remaining | Mm 1532-1462 (HEX) Assay % Remaining |
| AAT-364 | | 335 | | | | |
| AAT-366 | | 337 | | | | |
| AAT-367 | | 338 | 11.5 ± 8.7 | 58.7 ± 22.9 | | |
| AAT-368 | | 339 | 6.9 ± 14.4 | 67.2 ± 28.6 | | |
| AAT-369 | | 340 | 5.3 ± 21.7 | 81.5 ± 25.7 | | |
| AAT-370 | | 341 | 38.2 ± 15 | 70.3 ± 21.6 | | |
| AAT-371 | | 342 | 8.7 ± 3.2 | 82 ± 28.2 | | |
| AAT-391 | | 362 | 9.8 ± N/A | 60.8 ± N/A | | |
| AAT-392 | | 363 | | | | |
| AAT-393 | | 364 | | | | |
| AAT-394 | | 365 | 12.3 ± 13.1 | 33.8 ± 29.8 | | |
| AAT-395 | | 366 | 2.6 ± 3.3 | 23.6 ± 7.1 | | |
| AAT-475 | | 446 | 2.5 ± 10.2 | 18.8 ± 3.6 | | |
| AAT-477 | | 448 | 6.7 ± 11.5 | 38.1 ± 13.1 | | |
| AAT-480 | | 451 | 7.2 ± 8.1 | 38.9 ± 14.2 | | |
| AAT-481 | | 452 | 12.1 ± 6.1 | 40.7 ± 13.1 | | |
| AAT-482 | | 453 | | | | |
| AAT-483 | | 454 | 10.2 ± 18.9 | 26.5 ± 21.2 | | |
| AAT-484 | | 455 | 7.2 ± 8.8 | 22.1 ± 7.7 | | |
| AAT-485 | | 456 | 6.6 ± 9.5 | 20.6 ± 19.8 | | |
| AAT-486 | | 457 | 1.6 ± 3.3 | 18.5 ± 5.5 | | |
| AAT-487 | | 458 | 7.8 ± 2.3 | 33.1 ± 7.9 | | |
| AAT-488 | | 459 | 24.5 ± 7.8 | 45 ± 12.8 | | |
| AAT-489 | | 460 | 27.4 ± 8.9 | 54.3 ± 6.1 | | |
| AAT-490 | | 461 | 2.6 ± 27.3 | 30.7 ± 9.3 | | |
| AAT-491 | | 462 | 2.6 ± 15.9 | 25 ± 8.2 | | |
| AAT-492 | | 463 | 3.5 ± 5 | 25.4 ± 6.5 | | |
| AAT-493 | | 464 | 6.6 ± 20.1 | 34.6 ± 3.8 | | |
| AAT-494 | | 465 | 18.5 ± 5 | 42.2 ± 8.2 | | |
| AAT-495 | | 466 | 7.2 ± 5 | 31.3 ± 9.2 | | |
| AAT-496 | | 467 | 1.3 ± 1.7 | 21.6 ± 5.1 | | |
| AAT-497 | | 468 | 7.3 ± 11.9 | 30.3 ± 10.9 | | |
| AAT-498 | | 469 | 42.4 ± 4.1 | 64.8 ± 6.7 | | |
| AAT-499 | | 470 | 40.2 ± 3 | 59 ± 3.6 | | |
| AAT-500 | | 471 | 7.9 ± 5.6 | 26.3 ± 3.1 | | |
| AAT-501 | | 472 | 9.4 ± 3.5 | 31.8 ± 8.6 | | |
| AAT-502 | | 473 | 11.5 ± 10.4 | 28.5 ± 7.9 | | |
| AAT-503 | | 474 | 21.5 ± 6.4 | 38.3 ± 11 | | |
| AAT-504 | | 475 | 13.3 ± 7.8 | 36.1 ± 8.4 | | |
| AAT-505 | 328 | | 17.9 ± 6.6 | 42.3 ± 3.1 | 40.4 ± 2.7 | 43.3 ± 5.2 |
| AAT-506 | 329 | | 33.5 ± 3.3 | 54.9 ± 7.5 | 51.7 ± 7.9 | 55.8 ± 8.6 |
| AAT-507 | 330 | | 26.5 ± 3.5 | 48 ± 3.8 | 56.8 ± 2.1 | 59.2 ± 2.9 |
| AAT-508 | 331 | | 10 ± 5.5 | 35.3 ± 5.3 | 26 ± 7.5 | 30.2 ± 5.5 |
| AAT-509 | 332 | | 75.6 ± 2.1 | 98.3 ± 6.2 | 75.3 ± 5.1 | 77.3 ± 4 |
| AAT-510 | | 481 | 88.4 ± 2.1 | 105.1 ± 3.8 | | |
| AAT-512 | | 483 | 31.6 ± 1.2 | 62.6 ± 4 | | |
| AAT-513 | | 484 | 13.1 ± 5.5 | 27.4 ± 2.4 | | |
| AAT-515 | | 486 | 27 ± 6.8 | 44.9 ± 5.6 | | |
| AAT-516 | | 487 | 43 ± 7 | 63.6 ± 17.4 | | |
| AAT-517 | | 488 | 22.8 ± 4.9 | 38.6 ± 4.4 | | |
| AAT-518 | | 489 | 20.7 ± 1.4 | 37.2 ± 5.8 | | |
| AAT-519 | | 490 | 9.5 ± 7.6 | 24 ± 2 | | |
| AAT-520 | | 491 | 43.9 ± 1.7 | 63.8 ± 10.1 | | |
| AAT-521 | | 492 | 7.4 ± 12.8 | 52.9 ± 15.8 | | |
| AAT-522 | | 493 | 35.6 ± 4.9 | 77.6 ± 15.8 | | |
| AAT-523 | | 494 | 48.6 ± 9.4 | 98.5 ± 17.4 | | |
| AAT-524 | | 495 | 54.9 ± 8.9 | 122.3 ± 12.2 | | |
| AAT-525 | | 496 | 20.3 ± 28.7 | 53.4 ± 23.3 | | |
| AAT-526 | | 497 | 5.2 ± 27.3 | 58.2 ± 7.1 | | |
| AAT-527 | | 498 | 24.4 ± 13.3 | 81.1 ± 9.9 | | |
| AAT-528 | | 499 | 26.2 ± 13 | 82.3 ± 6.1 | | |
| AAT-529 | | 500 | 53.4 ± 12.9 | 91.7 ± 26.6 | | |
| AAT-530 | | 501 | 40.8 ± 14.3 | 77.3 ± 23.4 | | |
| AAT-531 | | 502 | 22.3 ± 10.5 | 53 ± 7 | | |
| AAT-532 | | 503 | 11.4 ± 6 | 39.5 ± 18 | | |
| AAT-535 | | 506 | 50 ± 9.8 | 59.5 ± 18.1 | | |
| AAT-540 | | 511 | 10.6 ± 6.6 | 34 ± 15.5 | | |
| AAT-541 | | 512 | 57.2 ± 1.8 | 82 ± 0.4 | | |

TABLE 22-continued

α-1 Antitrypsin Inhibitory Efficacy of DsiRNAs Assayed at 1 nM in Human Huh7 and Mouse AML12 Cells

| Duplex Name | Mm Location | Rhesus Location | Human - Huh7 Normalized HPRT/SFRS9; vs NC1, NC5, NC7 | | Mouse - AML12 Normalized HPRT/Rpl23; vs NC1, NC5, NC7 | |
|---|---|---|---|---|---|---|
| | | | Hs 462-563 (FAM) Assay % Remaining | Hs 1811-1910 (HEX) Assay % Remaining | Mm 331-462 (FAM) Assay % Remaining | Mm 1532-1462 (HEX) Assay % Remaining |
| AAT-552 | | 523 | 10.4 ± 15.3 | 51.4 ± 7.7 | | |
| AAT-555 | | 526 | 71.2 ± 8.8 | 96.6 ± 15.2 | | |
| AAT-556 | | 527 | 3.6 ± 12.8 | 35 ± 11.1 | | |
| AAT-557 | | 528 | 4 ± 11.6 | 28.5 ± 8.7 | | |
| AAT-558 | | 529 | 12.8 ± 8.2 | 26.9 ± 5.3 | | |
| AAT-579 | | 550 | 7.9 ± 6.4 | 32.8 ± 11 | | |
| AAT-580 | | 551 | 28.1 ± 3.4 | 46.1 ± 5.4 | | |
| AAT-581 | | 552 | 3 ± 14.9 | 29 ± 13.4 | | |
| AAT-582 | | 553 | 12.5 ± 16 | 47.8 ± 6.9 | | |
| AAT-583 | | 554 | 5.9 ± 14.5 | 22.2 ± 26.5 | | |
| AAT-584 | | 555 | 12.9 ± 15 | 28.6 ± 21.8 | | |
| AAT-585 | | 556 | 31.9 ± 18.8 | 54.7 ± 23.3 | | |
| AAT-586 | | 557 | 3.3 ± 26.3 | 28.8 ± 19.8 | | |
| AAT-587 | | 558 | 5.6 ± 24 | 24.9 ± 31.1 | | |
| AAT-632 | | 603 | 13.7 ± 30.4 | 35.9 ± 28.4 | | |
| AAT-633 | | 604 | 43.2 ± 7.1 | 66.4 ± 15.6 | | |
| AAT-634 | | 605 | 17.2 ± 12.5 | 42.4 ± 7.5 | | |
| AAT-637 | | 608 | 84.6 ± 2.8 | 89.5 ± 7.6 | | |
| AAT-638 | | 609 | 16.8 ± 10.4 | 24.1 ± 14.3 | | |
| AAT-671 | | 642 | 39.2 ± 8.7 | 53 ± 12.8 | | |
| AAT-673 | | 644 | 8 ± 5.1 | 22.2 ± 6.4 | | |
| AAT-674 | | 645 | 27.9 ± 1.4 | 39.5 ± 2.4 | | |
| AAT-675 | | 646 | 11.2 ± 5.9 | 24.4 ± 14.5 | | |
| AAT-676 | | 647 | 92.1 ± 3.2 | 116.5 ± 5.4 | | |
| AAT-734 | | 705 | 74.3 ± 4.5 | 94.5 ± 3.5 | | |
| AAT-735 | | 706 | 8.4 ± 11.2 | 17.1 ± 21.3 | | |
| AAT-736 | | 707 | 5.1 ± 8.8 | 9.6 ± 12.1 | | |
| AAT-737 | | 708 | 2.8 ± 12.5 | 12.9 ± 4.4 | | |
| AAT-738 | | 709 | 8.3 ± 4.9 | 21 ± 14 | | |
| AAT-739 | | 710 | 75.3 ± 9.1 | 79.8 ± 15.3 | | |
| AAT-740 | | 711 | 4 ± 4.5 | 12.6 ± 7.2 | | |
| AAT-767 | | 738 | 3.5 ± 9.2 | 18.9 ± 12.4 | | |
| AAT-768 | | 739 | 57.5 ± 8.4 | 79.3 ± 8.9 | | |
| AAT-801 | | 772 | 56.1 ± 5.3 | 64 ± 5.3 | | |
| AAT-802 | | 773 | 12.8 ± 8.2 | 31.5 ± 5.5 | | |
| AAT-803 | | 774 | 8.4 ± 22.1 | 29.2 ± 34.4 | | |
| AAT-804 | | 775 | 42.7 ± 17.7 | 72.7 ± 17.6 | | |
| AAT-805 | | 776 | 6.7 ± 28 | 33.3 ± 26.4 | | |
| AAT-806 | | 777 | 13.5 ± 20.9 | 35.2 ± 11.3 | | |
| AAT-807 | | 778 | 5.8 ± 11.5 | 32.3 ± 5.8 | | |
| AAT-808 | | 779 | 33.6 ± 6.5 | 71.8 ± 11.4 | | |
| AAT-809 | | 780 | 30.7 ± 3.3 | 44.8 ± 5.8 | | |
| AAT-810 | | 781 | 2.5 ± 11.5 | 16.7 ± 7.5 | | |
| AAT-811 | | 782 | 10.4 ± 6.9 | 21.5 ± 4.2 | | |
| AAT-812 | | 783 | 2.4 ± 8.3 | 11.5 ± 6 | | |
| AAT-813 | | 784 | 15.3 ± 5.3 | 31.1 ± 3.4 | | |
| AAT-850 | | 821 | 28.1 ± 9.1 | 42.4 ± 7 | | |
| AAT-851 | | 822 | 26.4 ± 3.7 | 44.6 ± 7.2 | | |
| AAT-852 | | 823 | 22.7 ± 4.3 | 52.9 ± 9.8 | | |
| AAT-853 | | 824 | 4.2 ± 2.9 | 13.3 ± 19.9 | | |
| AAT-854 | | 825 | 27.8 ± 6.7 | 39.1 ± 14.2 | | |
| AAT-855 | | 826 | 6.9 ± 7.4 | 20.3 ± 17.6 | | |
| AAT-856 | | 827 | 11.3 ± 4.9 | 20.4 ± 7.4 | | |
| AAT-857 | | 828 | 5.1 ± 4.1 | 17.9 ± 5.4 | | |
| AAT-858 | | 829 | 8 ± 9.8 | 16.2 ± 20.5 | | |
| AAT-859 | | 830 | 5 ± 1.9 | 23 ± 9.3 | | |
| AAT-860 | | 831 | 58.4 ± 4.4 | 78.7 ± 10.1 | | |
| AAT-861 | | 832 | 83.5 ± 7.1 | 98.7 ± 4.3 | | |
| AAT-862 | | 833 | 5.5 ± 30.4 | 22.3 ± 29.8 | | |
| AAT-863 | | 834 | 21.1 ± 15.3 | 39.2 ± 14.1 | | |
| AAT-864 | | 835 | 72.9 ± 4.5 | 107.3 ± 7 | | |
| AAT-865 | | 836 | 29.1 ± 17.1 | 52 ± 16 | | |
| AAT-866 | | 837 | 7.3 ± 15.3 | 25.3 ± 4.7 | | |
| AAT-867 | | 838 | 32.1 ± 11.2 | 52.8 ± 9 | | |
| AAT-868 | | 839 | 43.1 ± 29.3 | 78.2 ± 17.5 | | |
| AAT-869 | | 840 | 10 ± 2.3 | 16.1 ± 5.5 | | |
| AAT-870 | | 841 | 23.9 ± 8.7 | 35.4 ± 8.5 | | |
| AAT-871 | | 842 | 73.3 ± 3.3 | 85.9 ± 2.6 | | |

TABLE 22-continued

α-1 Antitrypsin Inhibitory Efficacy of DsiRNAs Assayed at 1 nM in Human Huh7 and Mouse AML12 Cells

| Duplex Name | Mm Location | Rhesus Location | Human - Huh7 Normalized HPRT/SFRS9; vs NC1, NC5, NC7 | | Mouse - AML12 Normalized HPRT/Rpl23; vs NC1, NC5, NC7 | |
|---|---|---|---|---|---|---|
| | | | Hs 462-563 (FAM) Assay % Remaining | Hs 1811-1910 (HEX) Assay % Remaining | Mm 331-462 (FAM) Assay % Remaining | Mm 1532-1462 (HEX) Assay % Remaining |
| AAT-872 | | 843 | 13.4 ± 2.8 | 29.7 ± 5.9 | | |
| AAT-896 | | 867 | 5 ± 14.6 | 20.3 ± 6.8 | | |
| AAT-897 | | 868 | 4.2 ± 18 | 18.3 ± 10.1 | | |
| AAT-898 | | 869 | 1.5 ± 5.2 | 13.4 ± 5.1 | | |
| AAT-899 | | 870 | 3.8 ± 28.3 | 21.7 ± 15.8 | | |
| AAT-900 | | 871 | 4.6 ± 4.9 | 11.6 ± 8.3 | | |
| AAT-901 | | 872 | 4.4 ± 4 | 14.8 ± 17.4 | | |
| AAT-902 | | 873 | 5.2 ± 1.4 | 16.5 ± 0.9 | | |
| AAT-903 | | 874 | 18.3 ± 5.9 | 35.8 ± 9.1 | | |
| AAT-904 | | 875 | 20.7 ± 3.8 | 37.2 ± 2.4 | | |
| AAT-905 | | 876 | 4.8 ± 3.3 | 20.5 ± 5 | | |
| AAT-906 | | 877 | 3.3 ± 8.1 | 18.4 ± 2.9 | | |
| AAT-907 | | 878 | 11 ± 19.1 | 36.3 ± 17.4 | | |
| AAT-908 | | 879 | 21.3 ± 19.7 | 41.2 ± 16.7 | | |
| AAT-909 | | 880 | 7.5 ± 17.9 | 32.8 ± 9.1 | | |
| AAT-910 | | 881 | 5.7 ± 24.9 | 28.8 ± 11.8 | | |
| AAT-911 | | 882 | 4.4 ± 30 | 28.3 ± 27.3 | | |
| AAT-912 | | 883 | 15.1 ± 13.2 | 36.7 ± 15.3 | | |
| AAT-913 | | 884 | 11.6 ± 18.8 | 33.9 ± 11.3 | | |
| AAT-914 | | 885 | 26 ± 24 | 53.8 ± 14.1 | | |
| AAT-915 | | 886 | 30.2 ± 6.8 | 62.1 ± 10.3 | | |
| AAT-916 | | 887 | 17.6 ± 11 | 35.3 ± 10.5 | | |
| AAT-917 | | 888 | 10.4 ± 8.7 | 28.7 ± 12.6 | | |
| AAT-918 | | 889 | 36.6 ± 5.3 | 53.2 ± 2.8 | | |
| AAT-919 | | 890 | 64.9 ± 1.7 | 88.7 ± 3.2 | | |
| AAT-922 | | 893 | 11.4 ± 5.9 | 26.5 ± 4.9 | | |
| AAT-924 | | 895 | 42 ± 4.9 | 58.2 ± 1.7 | | |
| AAT-926 | | 897 | 102.4 ± 3.3 | 132 ± 6 | | |
| AAT-927 | | 898 | 113 ± 1.6 | 143.8 ± 6.1 | | |
| AAT-928 | | 899 | 15.2 ± 37 | 27.8 ± 23.2 | | |
| AAT-929 | | 900 | 21.5 ± 1.9 | 38 ± 3.7 | | |
| AAT-930 | | 901 | 49.6 ± 5 | 60.6 ± 2.3 | | |
| AAT-931 | | 902 | 50.3 ± 6.9 | 82.5 ± 12.2 | | |
| AAT-932 | | 903 | 77.5 ± 10.1 | 98 ± 4.3 | | |
| AAT-933 | | 904 | 21.8 ± 7.5 | 41.2 ± 8.7 | | |
| AAT-934 | | 905 | 38.3 ± 3.7 | 55.3 ± 7.5 | | |
| AAT-935 | | 906 | 13 ± 12.7 | 32.6 ± 7.1 | | |
| AAT-968 | | 939 | 16 ± 14.4 | 33.2 ± 17.8 | | |
| AAT-969 | | 940 | 104.5 ± 5.3 | 141.3 ± 4.4 | | |
| AAT-970 | | 941 | 10.9 ± 19.6 | 26.6 ± 13.8 | | |
| AAT-971 | | 942 | 10.2 ± 11.5 | 30.8 ± 6.2 | | |
| AAT-973 | | 944 | 52.9 ± 12.8 | 78 ± 15.9 | | |
| AAT-974 | | 945 | 57.3 ± 8.1 | 80.5 ± 7.5 | | |
| AAT-976 | | 947 | 71.4 ± 9.7 | 101 ± 9.8 | | |
| AAT-1023 | | 994 | 17.2 ± 8.5 | 44.3 ± 10.3 | | |
| AAT-1024 | | 995 | 11.5 ± 6.9 | 26.6 ± 13 | | |
| AAT-1025 | | 996 | 10.2 ± 7.2 | 21.2 ± 9.5 | | |
| AAT-1026 | | 997 | 76.8 ± 2.7 | 98.8 ± 3.2 | | |
| AAT-1055 | | 1026 | 7.6 ± 2.7 | 22.9 ± 6.8 | | |
| AAT-1059 | 882 | | 93.5 ± 3.4 | 119.7 ± 8.9 | 110.7 ± 5 | 103.7 ± 3.5 |
| AAT-1060 | 883 | | 25.3 ± 5.5 | 62.7 ± 5.2 | 70.8 ± 3.2 | 61.5 ± 6.9 |
| AAT-1061 | 884 | | 61.8 ± 2.1 | 110.2 ± 5.2 | 98.4 ± 4.2 | 91.4 ± 2.2 |
| AAT-1062 | 885 | | 72.2 ± 4.6 | 90.1 ± 7.3 | 97 ± 4.3 | 95.9 ± 3 |
| AAT-1063 | 886 | | 24.7 ± 5.4 | 43.5 ± 7.5 | 62 ± 5.2 | 63.7 ± 3.1 |
| AAT-1064 | 887 | | 55.5 ± 7 | 72.8 ± 4.2 | 87.6 ± 6.7 | 90.9 ± 7.1 |
| AAT-1065 | 888 | | 23.2 ± 5.2 | 48.1 ± 3 | 60.8 ± 2.1 | 67.4 ± 2.9 |
| AAT-1066 | | 1037 | 9.1 ± 3.2 | 24.6 ± 3 | | |
| AAT-1067 | | 1038 | 12.8 ± 3.9 | 32 ± 7.5 | | |
| AAT-1068 | | 1039 | 47 ± 7.5 | 62.7 ± 6.9 | | |
| AAT-1069 | | 1040 | 8.2 ± 9.1 | 28.5 ± 10.8 | | |
| AAT-1070 | | 1041 | 11 ± 4.6 | 20.8 ± 19.1 | | |
| AAT-1072 | | 1043 | 65.1 ± 2.4 | 77.9 ± 5.5 | | |
| AAT-1073 | | 1044 | 15 ± 7.9 | 26.7 ± 3.8 | | |
| AAT-1074 | | 1045 | 47.7 ± 1.1 | 71.1 ± 1.1 | | |
| AAT-1075 | | 1046 | 20.2 ± N/A | 29.7 ± N/A | | |
| AAT-1076 | | 1047 | 82.6 ± 1.9 | 94.9 ± 2.1 | | |
| AAT-1077 | | 1048 | 11.9 ± 2.6 | 26 ± 7.8 | | |
| AAT-1078 | | 1049 | 16.6 ± 3.6 | 42.5 ± 1.3 | | |

TABLE 22-continued

α-1 Antitrypsin Inhibitory Efficacy of DsiRNAs Assayed at 1 nM in Human Huh7 and Mouse AML12 Cells

| | | | Human - Huh7 Normalized HPRT/SFRS9; vs NC1, NC5, NC7 | | Mouse - AML12 Normalized HPRT/Rpl23; vs NC1, NC5, NC7 | |
|---|---|---|---|---|---|---|
| Duplex Name | Mm Location | Rhesus Location | Hs 462-563 (FAM) Assay % Remaining | Hs 1811-1910 (HEX) Assay % Remaining | Mm 331-462 (FAM) Assay % Remaining | Mm 1532-1462 (HEX) Assay % Remaining |
| AAT-1079 | | 1050 | 40.3 ± 13.8 | 74.4 ± 8.2 | | |
| AAT-1080 | | 1051 | 21.9 ± 7.7 | 60 ± 12.9 | | |
| AAT-1081 | | 1052 | 43.5 ± 15.7 | 64.8 ± 13.4 | | |
| AAT-1083 | | 1054 | 87.1 ± 9.3 | 124.7 ± 12.6 | | |
| AAT-1095 | | 1066 | 15.3 ± 16.2 | 44.6 ± 23.1 | | |
| AAT-1096 | | 1067 | 5.1 ± 17.4 | 34.2 ± 27.5 | | |
| AAT-1097 | | 1068 | 53.1 ± 9.1 | 76.4 ± 17.7 | | |
| AAT-1099 | | 1070 | 99.1 ± 4.1 | 119.5 ± 11.4 | | |
| AAT-1100 | | 1071 | 74.9 ± 4.7 | 95.6 ± 6.9 | | |
| AAT-1101 | | 1072 | 39.8 ± 6.8 | 55.1 ± 13.9 | | |
| AAT-1102 | | 1073 | 18.5 ± 1.6 | 30.8 ± 4.8 | | |
| AAT-1103 | | 1074 | 35.9 ± 4.2 | 47.3 ± 3.7 | | |
| AAT-1104 | | 1075 | 8.3 ± 5.7 | 25.9 ± 11.5 | | |
| AAT-1105 | | 1076 | 9.5 ± 4.3 | 19.6 ± 9.1 | | |
| AAT-1108 | | 1079 | 7.6 ± 5.1 | 26.1 ± 2.7 | | |
| AAT-1113 | | 1084 | 91.1 ± 2.1 | 85.4 ± 7.8 | | |
| AAT-1114 | | 1085 | 56 ± 4.3 | 74.3 ± 4.8 | | |
| AAT-1115 | | 1086 | 13.1 ± 11.6 | 25.4 ± 21 | | |
| AAT-1116 | | 1087 | 5.8 ± 4.2 | 20.6 ± 13 | | |
| AAT-1117 | | 1088 | 15 ± 11.5 | 30 ± 18.1 | | |
| AAT-1118 | | 1089 | 6.6 ± 9.5 | 17.9 ± 10.8 | | |
| AAT-1138 | | 1109 | 36.3 ± 3.5 | 42 ± 5.4 | | |
| AAT-1139 | | 1110 | 27 ± 6.7 | 45.7 ± 3.4 | | |
| AAT-1140 | | 1111 | 100.4 ± 6.2 | 105.5 ± 3.6 | | |
| AAT-1141 | | 1112 | 16.7 ± 32.6 | 47 ± 34.4 | | |
| AAT-1142 | | 1113 | 18.9 ± 16.5 | 68.8 ± 12.2 | | |
| AAT-1143 | | 1114 | 10.1 ± 16 | 33.1 ± 21.4 | | |
| AAT-1144 | | 1115 | 19.7 ± 19.6 | 55.4 ± 31.2 | | |
| AAT-1145 | | 1116 | 31.4 ± 18.7 | 55.3 ± 26.9 | | |
| AAT-1165 | | 1136 | 41.6 ± 16.7 | 53.6 ± 15.3 | | |
| AAT-1166 | | 1137 | 12.5 ± 15.7 | 45.6 ± 19 | | |
| AAT-1167 | | 1138 | 76.7 ± 4.5 | 92 ± 5.4 | | |
| AAT-1168 | | 1139 | 29.2 ± 6 | 53.4 ± 17.4 | | |
| AAT-1169 | | 1140 | 57.7 ± 5 | 75.2 ± 5 | | |
| AAT-1170 | | 1141 | 2.8 ± 8.7 | 26.3 ± 21.9 | | |
| AAT-1171 | | 1142 | 2.2 ± 6.8 | 30.1 ± 10.2 | | |
| AAT-1172 | | 1143 | 9.5 ± 6.4 | 23.2 ± 16.1 | | |
| AAT-1173 | | 1144 | 21 ± 5.1 | 36.4 ± 2.8 | | |
| AAT-1174 | | 1145 | 10.5 ± 1.5 | 38.3 ± 10.5 | | |
| AAT-1175 | | 1146 | 9 ± 3.1 | 40.9 ± 1.4 | | |
| AAT-1176 | | 1147 | 16.4 ± 18.4 | 36 ± 25.5 | | |
| AAT-1232 | | 1203 | 18.8 ± 11.6 | 36.5 ± 9.2 | | |
| AAT-1233 | | 1204 | 2.2 ± 6.4 | 15.4 ± 5.5 | | |
| AAT-1234 | | 1205 | 3.8 ± 7 | 15.8 ± 7.1 | | |
| AAT-1235 | | 1206 | 3.7 ± 10.8 | 22.8 ± 20.1 | | |
| AAT-1236 | | 1207 | 6.3 ± 2.3 | 21.1 ± 11.2 | | |
| AAT-1237 | | 1208 | 7.6 ± 12.7 | 30.3 ± 31.2 | | |
| AAT-1238 | | 1209 | 52.8 ± 2.4 | 66.6 ± 9.6 | | |
| AAT-1239 | | 1210 | 9.1 ± 5.7 | 38.7 ± 8.6 | | |
| AAT-1240 | | 1211 | 15 ± 13.9 | 41.8 ± 23.3 | | |
| AAT-1279 | | 1250 | 8.7 ± 24.8 | 32.1 ± 24.3 | | |
| AAT-1280 | | 1251 | 11.3 ± 22.1 | 47.7 ± 19.8 | | |
| AAT-1281 | | 1252 | 56.5 ± 14.5 | 83.6 ± 15.6 | | |
| AAT-1283 | | 1254 | 69.8 ± 5.1 | 78.6 ± 7.8 | | |
| AAT-1284 | | 1255 | 89.3 ± 8 | 116.1 ± 5.9 | | |
| AAT-1286 | | 1257 | 6.6 ± 1.8 | 46.4 ± 5.7 | | |
| AAT-1296 | 1119 | | 85.8 ± 5.4 | 107.3 ± 5 | 77.8 ± 1.4 | 80.1 ± 3.4 |
| AAT-1297 | 1120 | | 85.6 ± 14.2 | 104.2 ± 11.6 | 94.4 ± 5.7 | 97.5 ± 3.5 |
| AAT-1298 | 1121 | | 94.6 ± 10.8 | 125.2 ± 7.3 | 80.7 ± 5.1 | 85 ± 6.5 |
| AAT-1324 | | 1295 | 49.8 ± 10 | 64.3 ± 13.8 | | |
| AAT-1325 | | 1296 | 38.5 ± 5.8 | 54 ± 10.6 | | |
| AAT-1326 | | 1297 | 6.7 ± 5.4 | 27.7 ± 9.4 | | |
| AAT-1336 | | 1307 | 19.5 ± 4.6 | 38.1 ± 15.1 | | |
| AAT-1337 | | 1308 | 34.1 ± 3.6 | 53.1 ± 3 | | |
| AAT-1338 | | 1309 | 78 ± 6.4 | 82.4 ± 2.6 | | |
| AAT-1339 | | 1310 | 8.4 ± 5.3 | 37.6 ± 14.8 | | |
| AAT-1348 | | 1319 | 22.6 ± 4.9 | 49 ± 5.3 | | |
| AAT-1352 | | 1323 | 19.9 ± 2.3 | 35.9 ± 15.2 | | |

TABLE 22-continued

α-1 Antitrypsin Inhibitory Efficacy of DsiRNAs Assayed at 1 nM in Human Huh7 and Mouse AML12 Cells

| Duplex Name | Mm Location | Rhesus Location | Human - Huh7 Normalized HPRT/SFRS9; vs NC1, NC5, NC7 | | Mouse - AML12 Normalized HPRT/Rpl23; vs NC1, NC5, NC7 | |
|---|---|---|---|---|---|---|
| | | | Hs 462-563 (FAM) Assay % Remaining | Hs 1811-1910 (HEX) Assay % Remaining | Mm 331-462 (FAM) Assay % Remaining | Mm 1532-1462 (HEX) Assay % Remaining |
| AAT-1353 | | 1324 | 3.4 ± 6.3 | 18.8 ± 8 | | |
| AAT-1354 | 1180 | | 37.9 ± 5.6 | 65.9 ± 12.6 | 64.8 ± 3.3 | 68.4 ± 5.5 |
| AAT-1355 | 1181 | | 30.3 ± 6.8 | 51.4 ± 9.7 | 52.5 ± 10.6 | 65.7 ± 4 |
| AAT-1356 | 1182 | | 39.7 ± 2.6 | 55.8 ± 5.6 | 53.4 ± 2.1 | 58.4 ± 5.7 |
| AAT-1357 | 1183 | | 22.5 ± 5.4 | 36.6 ± 3.1 | 34.3 ± 8 | 41.9 ± 5.5 |
| AAT-1358 | 1184 | | 22.7 ± 8.1 | 41.2 ± 10.2 | 33.6 ± 2.4 | 41.9 ± 4.3 |
| AAT-1359 | 1185 | | 46.2 ± 4.9 | 59.5 ± 8.1 | 24.7 ± 16.2 | 27.5 ± 15.8 |
| AAT-1360 | 1186 | | 7.7 ± 2.9 | 28.3 ± 8.3 | 19.9 ± 7.7 | 22.7 ± 4.6 |
| AAT-1361 | 1187 | | 11.1 ± 6 | 29 ± 1.2 | 14.5 ± 6 | 17.8 ± 9.9 |
| AAT-1390 | | 1361 | 55.2 ± 4.2 | 72.7 ± 9 | | |
| AAT-1391 | | 1362 | 18.9 ± 5.7 | 44 ± 8.8 | | |
| AAT-1392 | | 1363 | 15.8 ± 2.4 | 31.8 ± 8.1 | | |
| AAT-1393 | | 1364 | 66 ± 3.8 | 74.4 ± 2.7 | | |
| AAT-1394 | | 1365 | 54.5 ± 3.9 | 70.2 ± 7.5 | | |
| AAT-1395 | | 1366 | 11.7 ± 5.9 | 50.8 ± 8.4 | | |
| AAT-1404 | | 1375 | 45.9 ± 11.7 | 71.1 ± 12.5 | | |
| AAT-1405 | | 1376 | 47.3 ± 24.1 | 75.8 ± 30.3 | | |
| AAT-1406 | | 1377 | 11.6 ± 37 | 33.5 ± 21.1 | | |
| AAT-1407 | | 1378 | 24.1 ± 27.7 | 52.6 ± 26.2 | | |
| AAT-1408 | | 1379 | 10.4 ± 29.8 | 32.9 ± 25.7 | | |
| AAT-1409 | | 1380 | 56.7 ± 17.7 | 72.6 ± 20.1 | | |
| AAT-1410 | | 1381 | 75.9 ± 8.6 | 107.5 ± 5.6 | | |
| AAT-1411 | | 1382 | 18.4 ± 6.2 | 58.8 ± 11.5 | | |
| AAT-1412 | | 1383 | 27.7 ± 23.1 | 44.4 ± 16.4 | | |
| AAT-1413 | | 1384 | 48.7 ± 3.8 | 66 ± 6.3 | | |
| AAT-1414 | | 1385 | 62.3 ± 9.1 | 72.2 ± 7.8 | | |
| AAT-1415 | | 1386 | 62.6 ± 5.1 | 82.8 ± 3.5 | | |
| AAT-1416 | | 1387 | 2.6 ± 4.7 | 19.3 ± 2.7 | | |
| AAT-1442 | | 1413 | 5.6 ± 8.9 | 24.5 ± 8.6 | | |
| AAT-1443 | | 1414 | 3.4 ± 13.6 | 25.6 ± 16.4 | | |
| AAT-1444 | | 1415 | 12.3 ± 7.4 | 40.7 ± 11.7 | | |
| AAT-1445 | | 1416 | 2.5 ± 6 | 20.5 ± 11.8 | | |
| AAT-1446 | | 1417 | 12.8 ± 9.3 | 19.6 ± 16.4 | | |
| AAT-1447 | | 1418 | 8.5 ± 12 | 25.5 ± 13.5 | | |
| AAT-1448 | | 1419 | 2.4 ± 5.9 | 18.6 ± 14.5 | | |
| AAT-1449 | | 1420 | 2.2 ± 4.6 | 15.9 ± 6.8 | | |
| AAT-1450 | | 1421 | 2.1 ± 8.5 | 17.2 ± 6 | | |
| AAT-1451 | | 1422 | 4.5 ± 5.8 | 23.3 ± 7 | | |
| AAT-1452 | | 1423 | 26.9 ± 2.1 | 56.7 ± 12.5 | | |
| AAT-1453 | | 1424 | 3.5 ± 26 | 53.5 ± 29.2 | | |
| AAT-1454 | | 1425 | 4.7 ± 21.9 | 39.8 ± 22.4 | | |
| AAT-1455 | | 1426 | 7.7 ± 38.9 | 39.7 ± 43.7 | | |
| AAT-1456 | | 1427 | 7.4 ± 22.9 | 41.7 ± 20.3 | | |
| AAT-1457 | | 1428 | 7.5 ± 27.6 | 47.5 ± 29.3 | | |
| AAT-1458 | | 1429 | 6.1 ± 20.3 | 53.2 ± 7.5 | | |
| AAT-1459 | | 1430 | 3.2 ± 10.6 | 41.1 ± 19.7 | | |
| AAT-1460 | | 1431 | 6.3 ± 14.8 | 40.8 ± 5.9 | | |
| AAT-1461 | | 1432 | 2.5 ± 12.5 | 32.9 ± 8.8 | | |
| AAT-1462 | | 1433 | 1.8 ± 4.4 | 23.4 ± 14.5 | | |
| AAT-1463 | | 1434 | 1.9 ± 4.7 | 23.8 ± 10.3 | | |
| AAT-1464 | | 1435 | 1.9 ± 6.8 | 19.5 ± 23 | | |
| AAT-1465 | | 1436 | 1.7 ± 13.1 | 18.5 ± 14.5 | | |
| AAT-1466 | | 1437 | 9.3 ± 3.9 | 30.5 ± 3.5 | | |
| AAT-1467 | | 1438 | 56.6 ± 2.2 | 70.4 ± 3.6 | | |
| AAT-1468 | | 1439 | 6.2 ± 3.7 | 44.2 ± 4.3 | | |
| AAT-1469 | | 1440 | 3.7 ± 5.8 | 37.7 ± 8.2 | | |
| AAT-1470 | | 1441 | 3.2 ± 6.5 | 23.7 ± 4.2 | | |
| AAT-1471 | | 1442 | 1.6 ± 13.5 | 18 ± 31.3 | | |
| AAT-1472 | | 1443 | 1.3 ± 12.3 | 17.8 ± 15.1 | | |
| AAT-1473 | | 1444 | 2.8 ± 10.1 | 23.4 ± 10.2 | | |
| AAT-1474 | | 1445 | 4.5 ± 4.2 | 23.7 ± 4.2 | | |
| AAT-1475 | | 1446 | 11.1 ± 7.4 | 45.6 ± 10.6 | | |
| AAT-1476 | | 1447 | 7.1 ± 4.8 | 38.8 ± 5.9 | | |
| AAT-1477 | | 1448 | 2.8 ± 2.8 | 25.1 ± 9.6 | | |
| AAT-1478 | | 1449 | 5.2 ± 25.2 | 38.5 ± 24.7 | | |
| AAT-1479 | | 1450 | 13.3 ± 23.3 | 27.8 ± 11.5 | | |
| AAT-1480 | | 1451 | 35.7 ± 22.6 | 62.7 ± 29.2 | | |
| AAT-1481 | | 1452 | 5.4 ± 18.5 | 32 ± 18.6 | | |

TABLE 22-continued

α-1 Antitrypsin Inhibitory Efficacy of DsiRNAs Assayed at 1 nM in Human Huh7 and Mouse AML12 Cells

| | | | Human - Huh7 Normalized HPRT/SFRS9; vs NC1, NC5, NC7 | | Mouse - AML12 Normalized HPRT/Rpl23; vs NC1, NC5, NC7 | |
|---|---|---|---|---|---|---|
| Duplex Name | Mm Location | Rhesus Location | Hs 462-563 (FAM) Assay % Remaining | Hs 1811-1910 (HEX) Assay % Remaining | Mm 331-462 (FAM) Assay % Remaining | Mm 1532-1462 (HEX) Assay % Remaining |
| AAT-1482 | | 1453 | 6.9 ± 22.6 | 24.8 ± 20.7 | | |
| AAT-1483 | | 1454 | 12.4 ± 10.4 | 44 ± 21.5 | | |
| AAT-1484 | | 1455 | 50.9 ± 4.9 | 59 ± 10.9 | | |
| AAT-1485 | | 1456 | 73.7 ± 7.7 | 84.2 ± 2 | | |
| AAT-1486 | | 1457 | 13.7 ± 3.7 | 25.1 ± 8.4 | | |
| AAT-1487 | | 1458 | 11.7 ± 9.5 | 20.9 ± 9.1 | | |
| AAT-1488 | | 1459 | 3.5 ± 8.4 | 13.8 ± 5.8 | | |
| AAT-1489 | | 1460 | 3.3 ± 5 | 15.1 ± 7.1 | | |
| AAT-1490 | | 1461 | 10.2 ± 3.6 | 25.5 ± 13.5 | | |
| AAT-1491 | | 1462 | 10 ± 5.7 | 23.2 ± 2.6 | | |
| AAT-1492 | | 1463 | 23.8 ± 4.8 | 42.2 ± 4 | | |
| AAT-1493 | | 1464 | 26.7 ± 4.5 | 44.3 ± 16.9 | | |
| AAT-1494 | | 1465 | 30.4 ± 3.7 | 37.1 ± 4.5 | | |
| AAT-1495 | | 1466 | 7.1 ± 4.2 | 19.4 ± 13.2 | | |
| AAT-1496 | | 1467 | 17.6 ± 4.7 | 29.6 ± 2.5 | | |
| AAT-1497 | | 1468 | 17.3 ± 5.1 | 21.6 ± 10.9 | | |
| AAT-1499 | | 1470 | 106.7 ± 10.4 | 81.1 ± 5 | | |
| AAT-1501 | | 1472 | 38 ± 2.1 | 38.7 ± 2.9 | | |
| AAT-1502 | | 1473 | 10.5 ± 5 | 26.5 ± 6.1 | | |
| AAT-1503 | | 1474 | 39.4 ± 7.1 | 52.6 ± 14.8 | | |
| AAT-1504 | | 1475 | 9.1 ± 6.3 | 26.6 ± 17.1 | | |
| AAT-1505 | | 1476 | 7.4 ± 12 | 20.3 ± 9.8 | | |
| AAT-1506 | | 1477 | 60.9 ± 5.5 | 81.5 ± 2.5 | | |
| AAT-1507 | | 1478 | 3.9 ± 10.2 | 23.4 ± 10.9 | | |
| AAT-1508 | | 1479 | 5.4 ± 16.3 | 21.5 ± 22 | | |
| AAT-1509 | | 1480 | 12.7 ± 10.6 | 29.2 ± 25 | | |
| AAT-1510 | | 1481 | 5.7 ± 2.4 | 25.4 ± 27 | | |
| AAT-1511 | | 1482 | 15.7 ± 4.6 | 24 ± 8.5 | | |
| AAT-1512 | | 1483 | 57.5 ± 4.2 | 58.6 ± 7.8 | | |
| AAT-1513 | | 1484 | 6 ± 3.2 | 19.1 ± 7.2 | | |
| AAT-1514 | | 1485 | 21.7 ± 7.2 | 28.8 ± 10.7 | | |
| AAT-1515 | | 1486 | 72.4 ± 1.1 | 71.8 ± 0.6 | | |
| AAT-1516 | | 1487 | 18.3 ± 4.5 | 29.9 ± 8 | | |
| AAT-1517 | | 1488 | 6.6 ± 1 | 24.8 ± 2.4 | | |
| AAT-2872 | | | 122.6 ± 2.1 | 21.8 ± 15.2 | | |
| AAT-2880 | | | 104.5 ± 7.5 | 20.2 ± 16.1 | | |
| AAT-3167 | | | 96.3 ± 2.3 | 20.8 ± 8.4 | | |
| AAT-3169 | | | 90.4 ± 4.9 | 18.4 ± 5.9 | | |
| AAT-3170 | | | 86.8 ± 8.8 | 25.7 ± 12.5 | | |
| AAT-3172 | | | 93 ± 1.8 | 20.2 ± 3.2 | | |
| AAT-3175 | | | 85.6 ± 1.6 | 15.1 ± 3.5 | | |
| AAT-3180 | | | 90.2 ± 4.3 | 23.8 ± 5 | | |
| AAT-3181 | | | 114.4 ± 4.1 | 28.7 ± 6.1 | | |
| AAT-3182 | | | 114.2 ± 0.8 | 31.1 ± 2.6 | 109.1 ± 7.2 | 102.4 ± 5.6 |

Example 3

DsiRNA Inhibition of α-1 Antitrypsin—Secondary Screen 96 asymmetric DsiRNAs (96 targeting Hs α-1 antitrypsin, 7 of which also targeted Mm α-1 antitrypsin) of the above experiment were then examined in a secondary assay ("Phase 2"), with results of such assays presented in histogram form in FIGS. 3A to 3H. Specifically, the 96 asymmetric DsiRNAs selected from those tested above were assessed for inhibition of human α-1 antitrypsin at 1 nM, 0.1 nM and 0.03 nM in the environment of human Huh7 cells (FIGS. 3A to 3D). These 96 asymmetric DsiRNAs were also assessed for inhibition of mouse α-1 antitrypsin at 1 nM, 0.1 nM and 0.03 nM in the environment of mouse AML12 cells (FIGS. 3E to 3H). As shown in FIGS. 3A to 3D, most asymmetric DsiRNAs reproducibly exhibited significant human α-1 antitrypsin inhibitory efficacies at sub-nanomolar concentrations when assayed in the environment of Huh7 cells. In addition, as shown in FIGS. 3E to 3H, a limited number of asymmetric DsiRNAs were identified to possess significant mouse α-1 antitrypsin inhibitory efficacies at sub-nanomolar concentrations when assayed in the environment of mouse AML12 cells.

Example 4

Figure 4A:
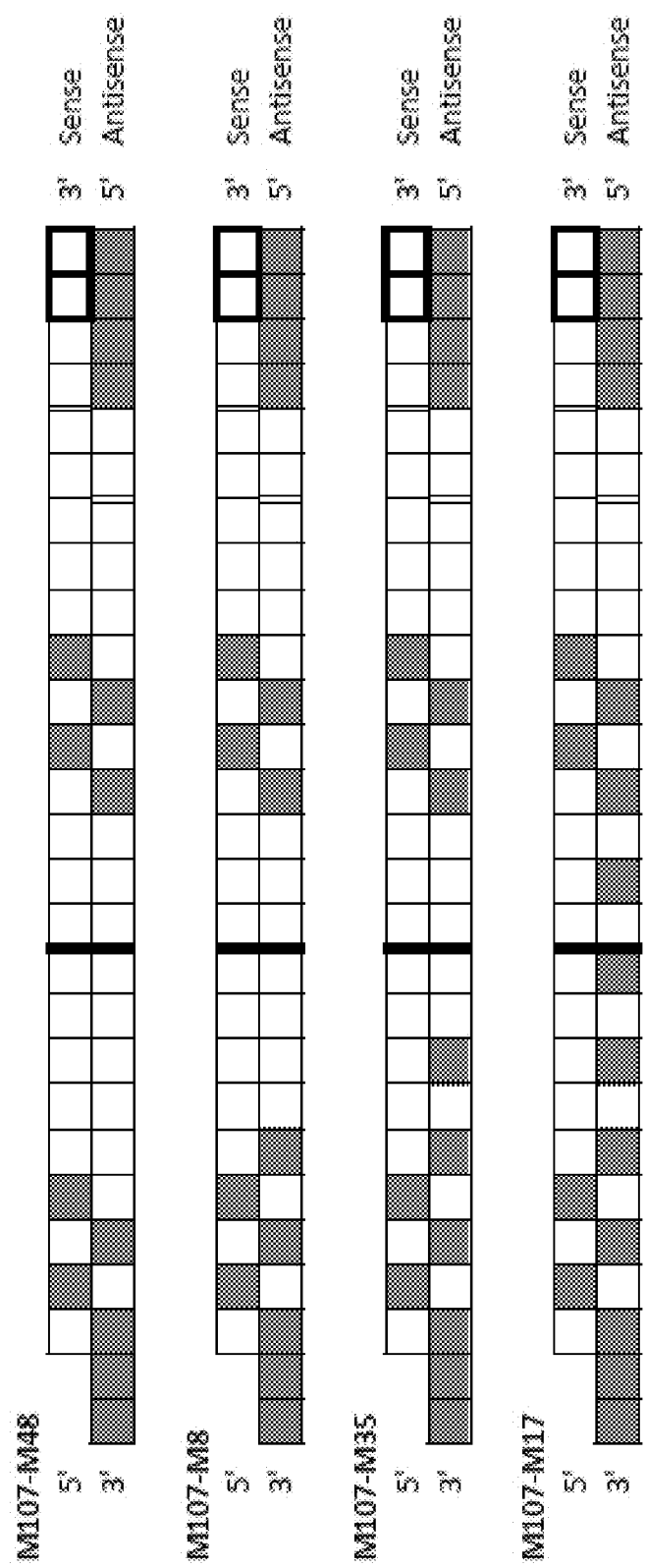
Figure 4B:
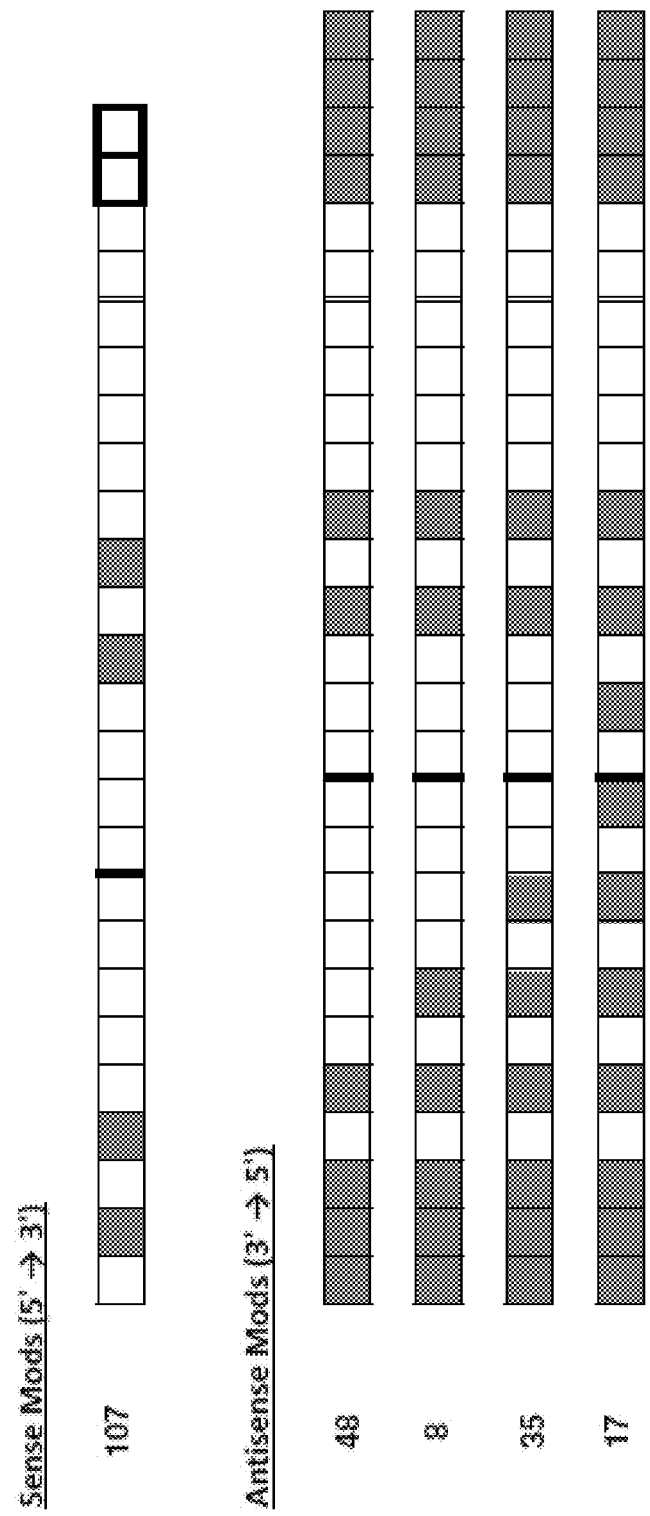
Figure 4D:
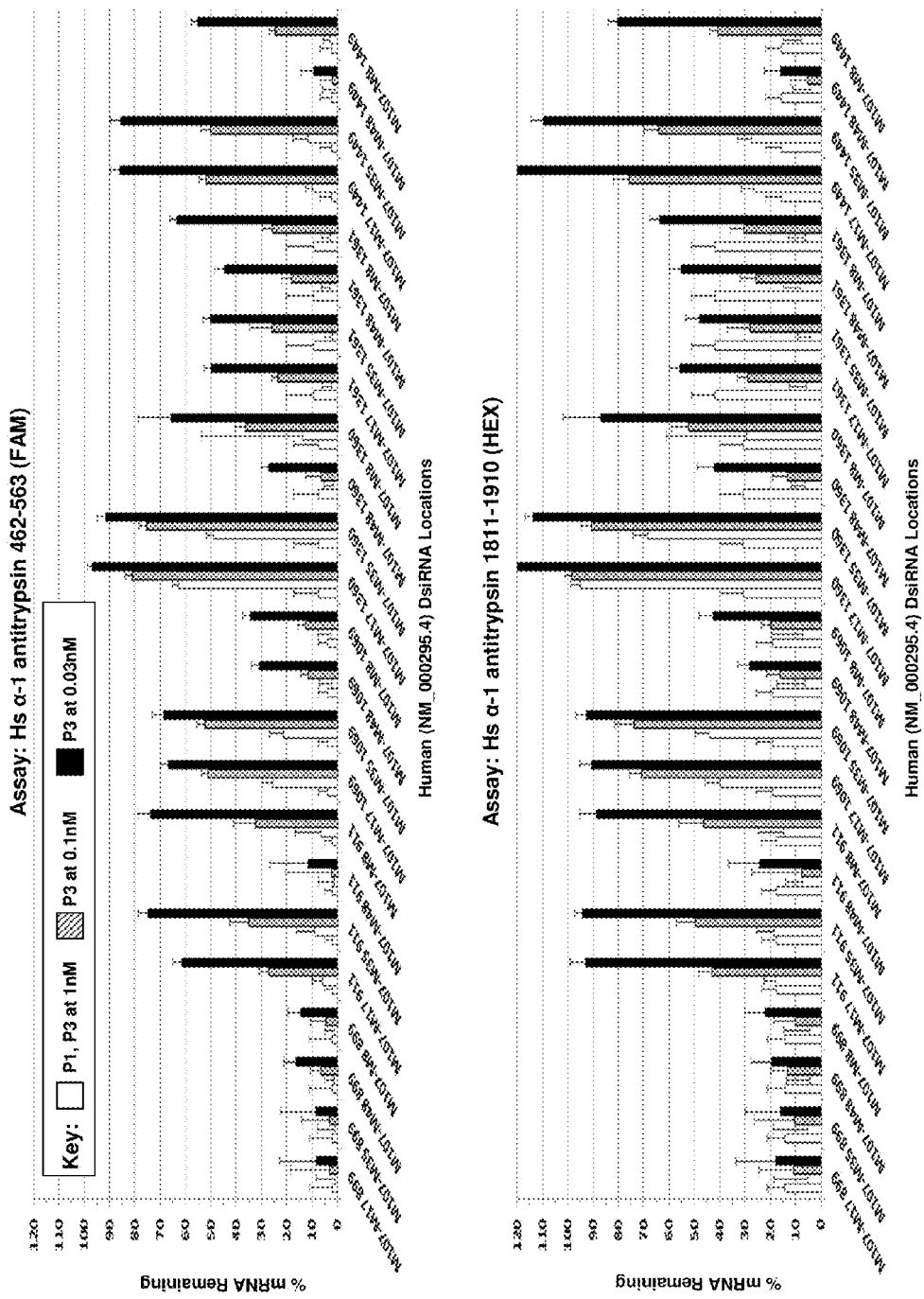

Modified Forms of α-1 Antitrypsin-Targeting DsiRNAs Reduced α-1 Antitrypsin Levels In Vitro Twenty-four α-1 antitrypsin-targeting DsiRNAs of the above initial screen (AAT-486, -490, -496, -508, -810, -898, -899, -911, -1069, -1360, -1361, -1449, -1450, -1453, -1458, -1459, -1460, -1461, -1462, -1463, -1465, -1471, -1476 and -1477) were prepared with 2'-O-methyl guide and passenger strand modification patterns as shown in the schematics of FIG. 4A (with individual strand modification patterns shown in isolation in FIG. 4B; modifications included "M107" modified passenger strands and above-described guide strand modification patterns "M8", "M17", "M35" and "M48"). For each of the twenty-four DsiRNA sequences, DsiRNAs possessing each of the four guide strand modification patterns M8, M17, M35 and M48 were assayed for α-1 antitrypsin inhibition in human Huh7 cells at 1.0 nM, 0.1 nM and 0.03 nM concentrations in the environment of the Huh7 cells. Results of these experiments are presented as histograms in FIGS. 4C to 4F. In general, the twenty-four DsiRNA sequences exhibited a trend towards reduced efficacy of α-1 antitrypsin inhibition as the extent of 2'-O-methyl modification of the guide strand increased. However, for all DsiRNA sequences examined, a modification pattern could be identified that allowed the DsiRNA to retain significant α-1 antitrypsin inhibitory efficacy in vitro. It was also notable that a number of these DsiRNAs (e.g., AAT-486, AAT-490, AAT-899, AAT-911, AAT-1361, AAT-1458, AAT-1459, AAT-1460, AAT-1462, AAT-1463, AAT-1465 and AAT-1477) exhibited robust α-1 antitrypsin inhibitory efficacy in even the most highly modified states examined. Thus, such highly active modified DsiRNA sequences possessed modification patterns believed to be capable of stabilizing such DsiRNAs and/or reducing immunogenicity of such DsiRNAs when therapeutically administered to a subject in vivo.

Example 5

Figure 5A:
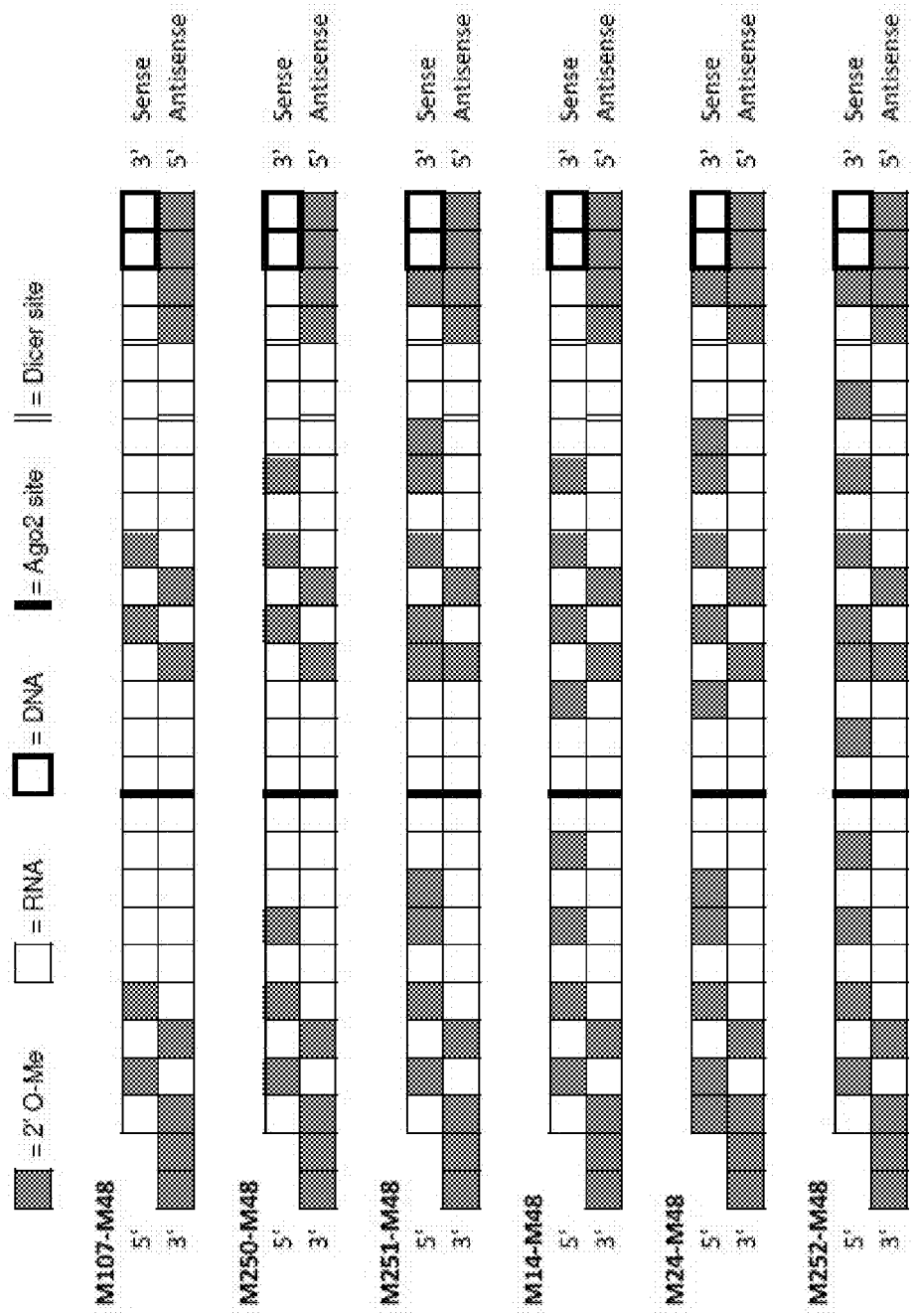
Figure 5B:
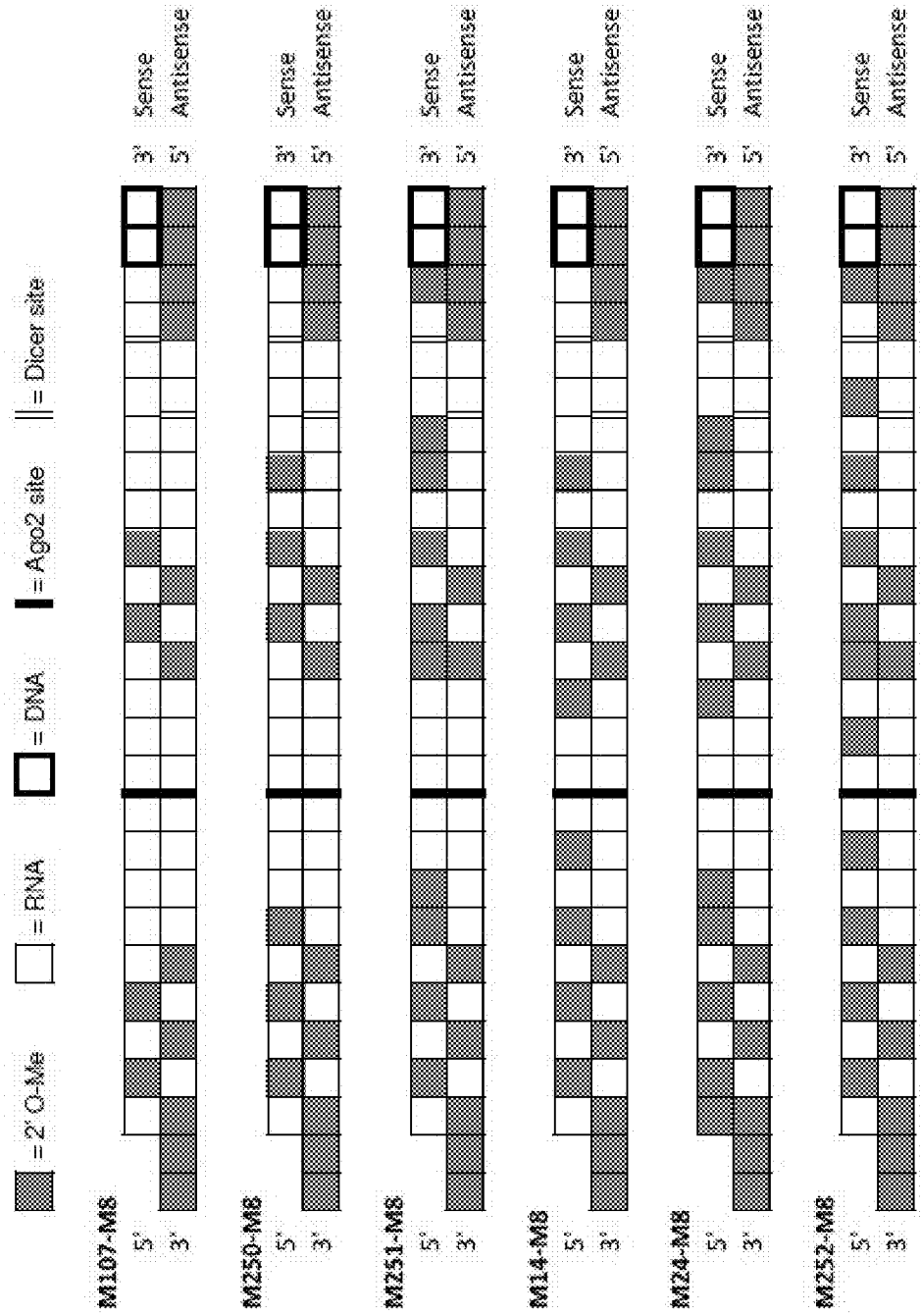
Figure 5C:
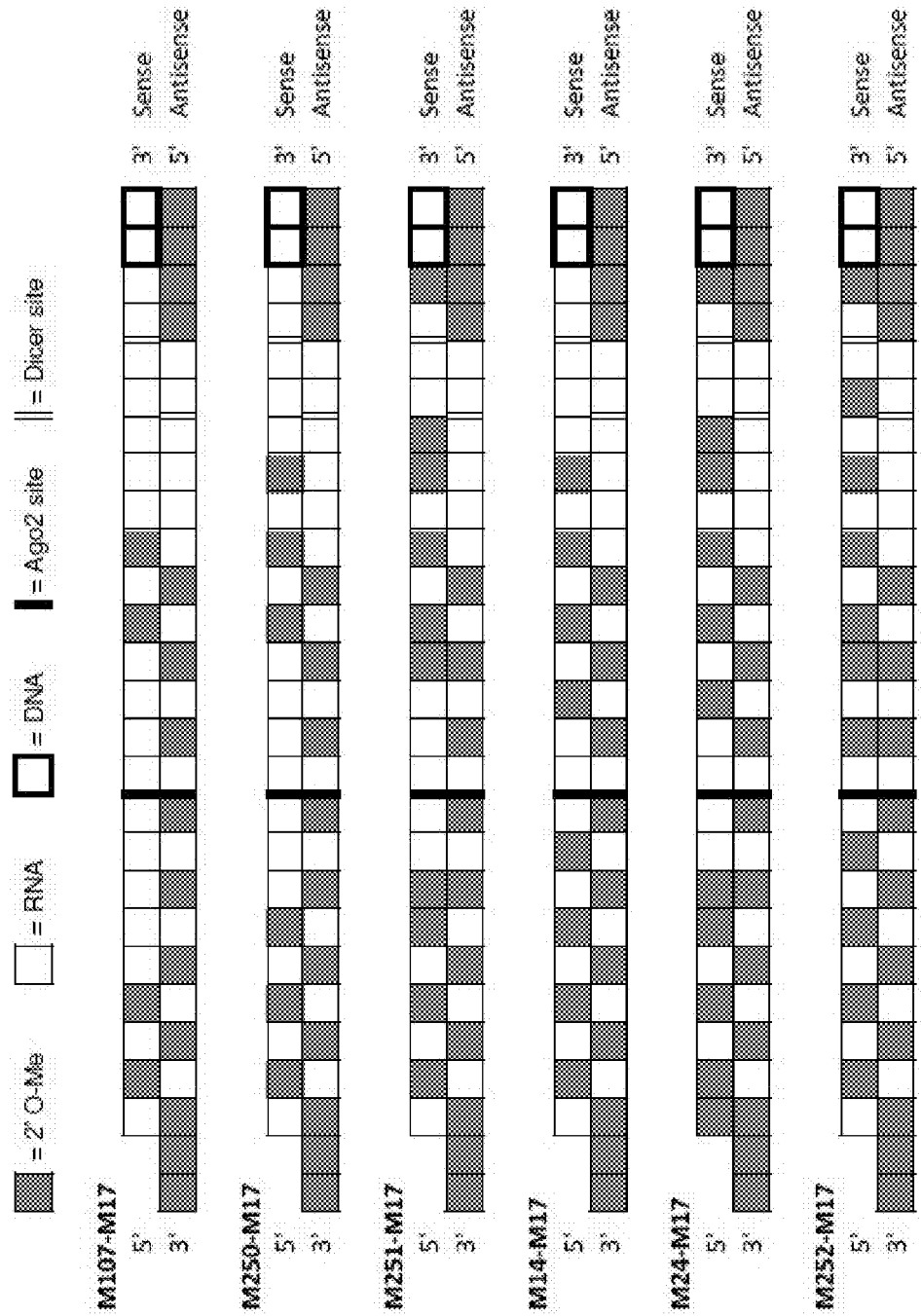
Figure 5D:
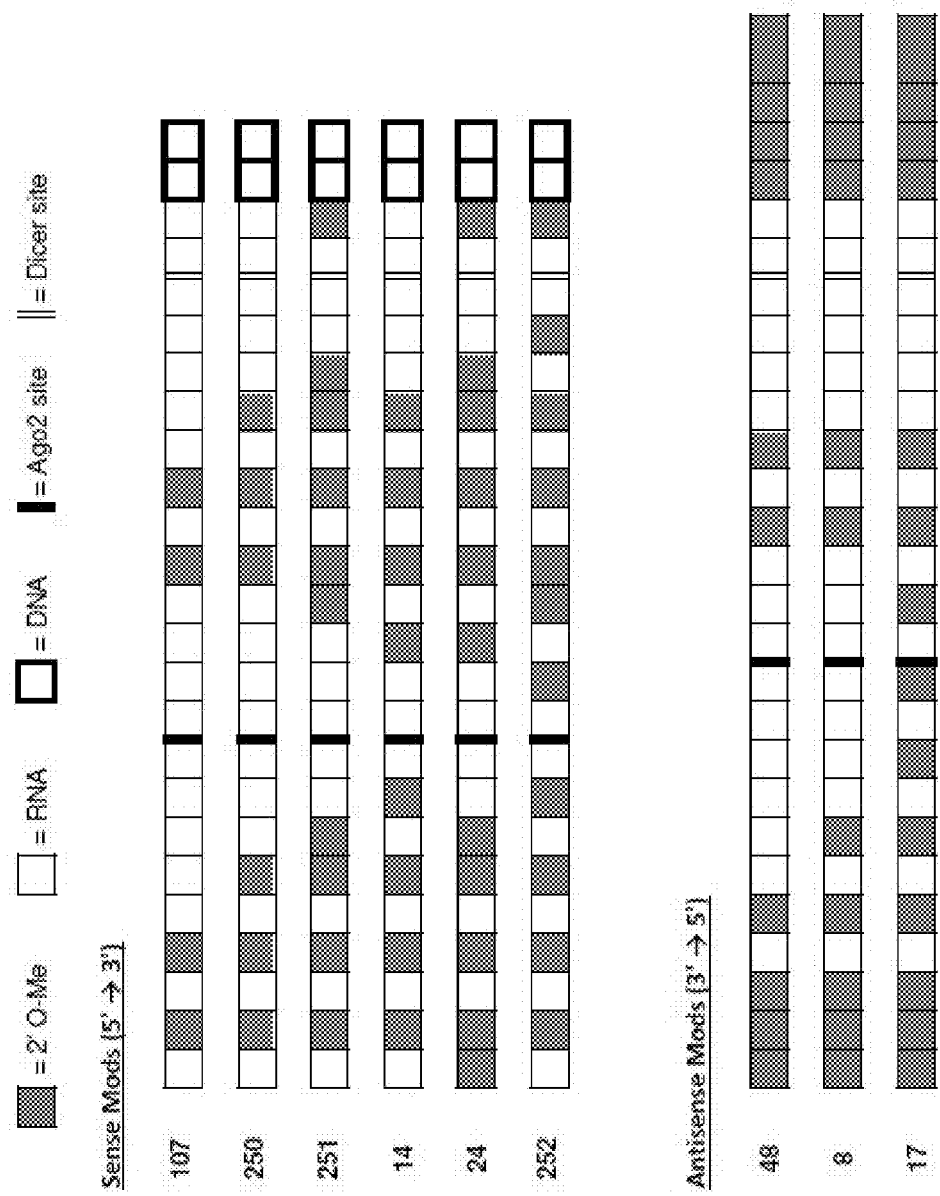

Additional Forms of α-1 Antitrypsin-Targeting DsiRNAs Possessing Modifications of Both Guide and Passenger Strands Reduced α-1 Antitrypsin Levels In Vitro Sixteen α-1 antitrypsin-Targeting DsiRNAs of the above experiments (AAT-490, AAT-496, AAT-810, AAT-898, AAT-899, AAT-1360, AAT-1361, AAT-1450, AAT-1453, AAT-1458, AAT-1459, AAT-1461, AAT-1462, AAT-1463, AAT-1471 and AAT-1477) were prepared with 2'-O-methyl passenger strand and guide strand modification patterns as represented above and in FIGS. 5A to 5C (including passenger strand modification patterns "SM14", "SM24", "SM107", "SM250", "SM251" and "SM252" and guide strand modification patterns "M48", "M8" and "M17"). For each of the sixteen DsiRNA sequences, DsiRNAs possessing each of the six passenger strand modification patterns M14, M24, M107, M250, M251 and M252 and one preferred guide strand modification pattern (selected from among guide strand modification patterns M48, M8 and M17) were assayed for α-1 antitrypsin inhibition in human Huh7 cells at 1.0 nM, 0.1 nM and 0.03 nM (30 picomolar) concentrations in the environment of the Huh7 cells. Results of these experiments are presented as histograms in FIGS. 5D to 5H. For all DsiRNA sequences examined, at least one duplex possessing extensive modification of both guide and passenger strands could be identified that allowed the DsiRNA to retain significant α-1 antitrypsin inhibitory efficacy in vitro. It was notable that many of these DsiRNAs (e.g., AAT-898, AAT-899, AAT-1461, AAT-1462, AAT-1463, AAT-1471 and AAT-1477) exhibited robust α-1 antitrypsin inhibitory efficacy across all modified states examined. Such highly active modified DsiRNA sequences possess modification patterns believed to be capable of stabilizing such DsiRNAs and/or reducing immunogenicity of such DsiRNAs when therapeutically administered to a subject in vivo.

Example 6

Figure 6A:
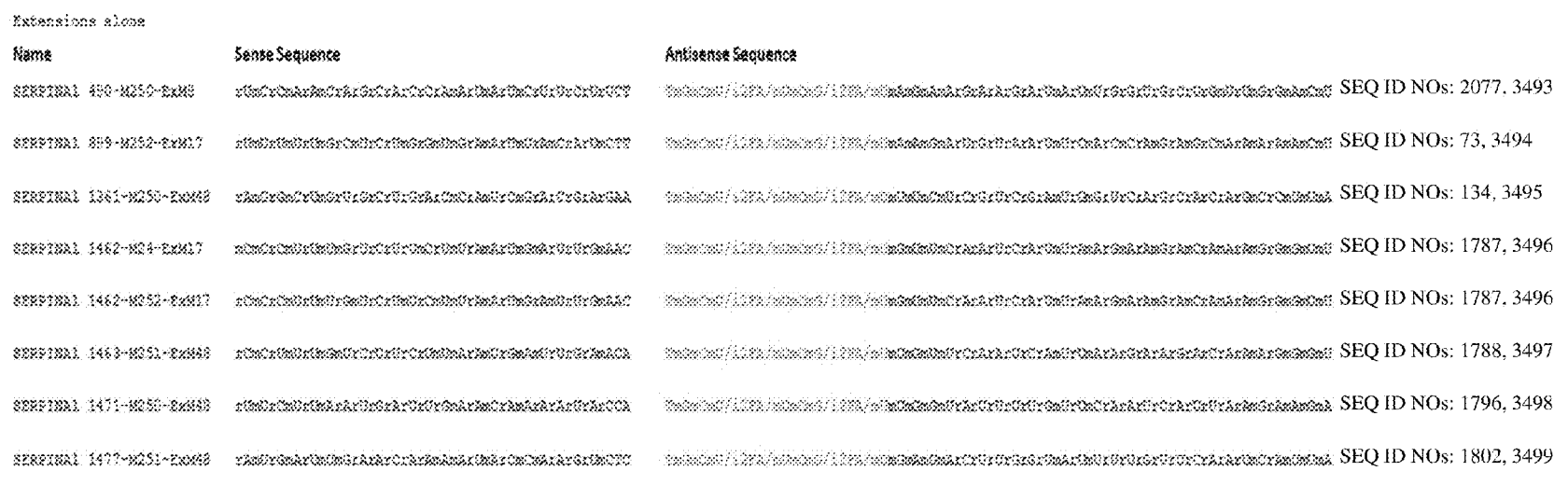

Synthesis and Testing of Single-Strand-Extended Forms of α-1 Antitrypsin-Targeting dsRNAs The following α-1 antitrypsin-targeting dsRNAs were also synthesized and possessed single-stranded 5' extensions of the guide strand (as also shown in FIG. 6A):

```
AAT-490-M250-ExM8
                                         (SEQ ID NO: 2077)
5'-UCCAACAGCACCAAUAUCUUCUUct-3'
                                         (SEQ ID NO: 3493)
3'-UCAGGUUGUCGUGGUUAUAGAAGAAGAUAGCUAUCGT-5'

AAT-899-M252-ExM17
                                          (SEQ ID NO: 73)
5'-UUUUUGCUCUGGUGAAUUACAUCtt-3'
                                         (SEQ ID NO: 3494)
3'-UCAAAAACGAGACCACUUAAUGUAGAAUAGCUAUCGT-5'

AAT-1361-M250-ExM48
                                         (SEQ ID NO: 134)
5'-AGGCUGUGCUGACCAUCGACGAGaa-3'
                                         (SEQ ID NO: 3495)
3'-AUUCCGACACGACUGGUAGCUGCUCUUUAGCUAUCGT-5'

AAT-1462-M24-ExM17
                                        (SEQ ID NO: 1787)
5'-CCCUUUGUCUUCUUAAUGAUUGAac-3'
                                        (SEQ ID NO: 3496)
3'-UUGGGAAACAGAAGAAUUACUAACUUGUAGCUAUCGT-5'

AAT-1462-M252-ExM17
                                        (SEQ ID NO: 1787)
5'-CCCUUUGUCUUCUUAAUGAUUGAac-3'
                                        (SEQ ID NO: 3496)
3'-UUGGGAAACAGAAGAAUUACUAACUUGUAGCUAUCGT-5'

AAT-1463-M251-ExM48
                                        (SEQ ID NO: 1788)
5'-CCUUUGUCUUCUUAAUGAUUGAAca-3'
                                        (SEQ ID NO: 3497)
3'-UGGGAAACAGAAGAAUUACUAACUUGUUAGCUAUCGT-5'

AAT-1471-M250-ExM48
                                        (SEQ ID NO: 1796)
5'-UUCUUAAUGAUUGAACAAAAUACca-3'
                                        (SEQ ID NO: 3498)
3'-AGAAGAAUUACUAACUUGUUUUAUGGUUAGCUAUCGT-5'

AAT-1477-M251-ExM48
                                        (SEQ ID NO: 1802)
5'-AUGAUUGAACAAAAUACCAAGUCtc-3'
                                        (SEQ ID NO: 3499)
3'-AUUACUAACUUGUUUUAUGGUUCAGAGUAGCUAUCGT-5'
``` where an underscore indicates a 2'-O-methyl RNA and "*A*" in bold, italics indicates a 2'-Fluoro-adenine residue.

Figure 6B:
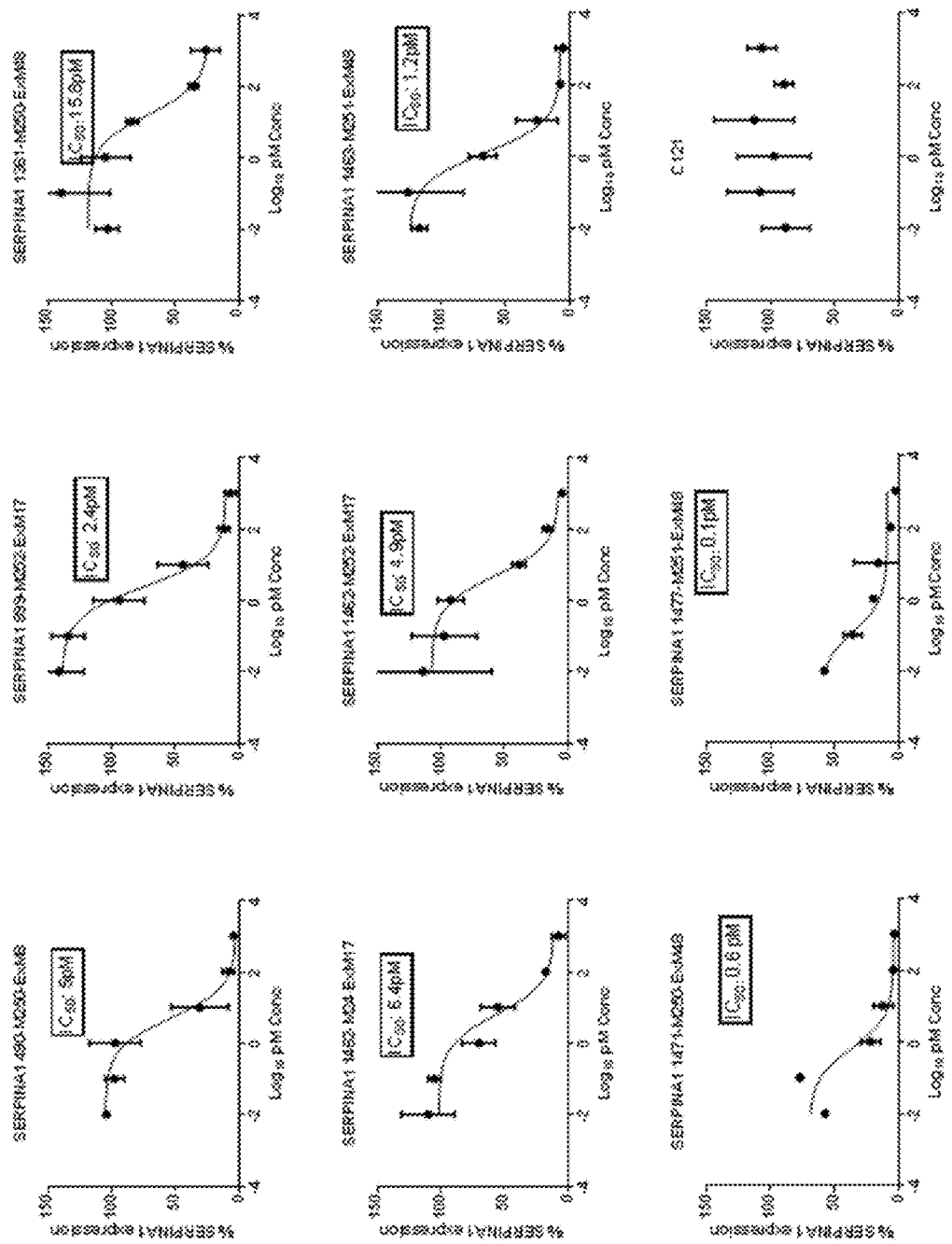

The above "single-strand-extended" (or "ss-extended") forms of the dsRNAs of the invention were also tested for α-1 antitrypsin knockdown activity in Huh7 cells, and as shown in FIG. 6B, all exhibited robust α-1 antitrypsin inhibitory efficacy, with all measured $IC_{50}$ values in the 0.1 to 20 pM range, and the lowest measured $IC_{50}$ value of 0.1 pM obtained for the AAT-1477-M251-ExM48 extended dsNA (referred to as "SERPINA1 1477-M251-ExM48" in FIG. 6B). Each of these extended froms of dsNA is also expected to exhibit a lack of immunogenicity (e.g., effectively no induction of IFN and/or PKR effect(s)) when administered in vivo and/or in an in vitro model or assay system for predicting or assessing in vivo immunogenicity, likely attributable to the masking provided by the modifications present within the single-strand extensions of these dsRNA sequences. Such dsRNA sequences possess modification patterns believed to be capable of stabilizing such dsRNAs and/or reducing immunogenicity of such dsRNAs—even for dsRNAs of such length—when therapeutically administered to a subject in vivo.

Example 7

Assessment of In Vivo Efficacy of α-1 Antitrypsin-Targeting DsiRNAs

The ability of certain, active α-1 antitrypsin-targeting DsiRNAs to reduce α-1 antitrypsin levels within a mouse, optionally a mouse model of liver disease is examined. Animals are randomized and assigned to groups based on marker levels. Dosing of animals with lipid nanoparticles (LNPs) containing DsiRNAs (optionally, an LNP formulation named EnCore-2072 is employed) is initiated on day 0. Animals are dosed at 5 mg/kg iv, tiw×2 (6 doses total). Animals are sacrificed 48 hrs after the last dose. Liver is dissected and weighed, and α-1 antitrypsin levels are assessed (optionally, for a mouse model of a liver disease or disorder, the extent of reduction and/or prevention of the disease or disorder is assessed).

Example 8

Indications

The present body of knowledge in α-1 antitrypsin research indicates the need for methods to assay α-1 antitrypsin activity and for compounds that can regulate α-1 antitrypsin expression for research, diagnostic, and therapeutic use. As described herein, the nucleic acid molecules of the present invention can be used in assays to diagnose disease state related to α-1 antitrypsin levels. In addition, the nucleic acid molecules can be used to treat disease state related to α-1 antitrypsin misregulation, levels, etc.

Particular disorders and disease states that can be associated with α-1 antitrypsin expression modulation include, but are not limited to chronic liver disease, liver inflammation, cirrhosis, liver fibrosis and hepatocellular carcinoma.

Other therapeutic agents can be combined with or used in conjunction with the nucleic acid molecules (e.g. DsiRNA molecules) of the instant invention. Those skilled in the art will recognize that other compounds and therapies used to treat the diseases and conditions described herein can be combined with the nucleic acid molecules of the instant invention (e.g. siNA molecules) and are hence within the scope of the instant invention. For example, for combination therapy, the nucleic acids of the invention can be prepared in one of at least two ways. First, the agents are physically combined in a preparation of nucleic acid and other agent, such as a mixture of a nucleic acid of the invention encapsulated in liposomes and other agent in a solution for intravenous administration, wherein both agents are present in a therapeutically effective concentration (e.g., the other agent in solution to deliver 1000-1250 mg/m2/day and liposome-associated nucleic acid of the invention in the same solution to deliver 0.1-100 mg/kg/day). Alternatively, the agents are administered separately but simultaneously or successively in their respective effective doses (e.g., 1000-1250 mg/m2/d other agent and 0.1 to 100 mg/kg/day nucleic acid of the invention).

Example 9

Serum Stability for DsiRNAs

Serum stability of DsiRNA agents is assessed via incubation of DsiRNA agents in 50% fetal bovine serum for various periods of time (up to 24 h) at 37° C. Serum is extracted and the nucleic acids are separated on a 20% non-denaturing PAGE and can be visualized with Gelstar stain. Relative levels of protection from nuclease degradation are assessed for DsiRNAs (optionally with and without modifications).

Example 10

Diagnostic Uses

The DsiRNA molecules of the invention can be used in a variety of diagnostic applications, such as in the identification of molecular targets (e.g., RNA) in a variety of applications, for example, in clinical, industrial, environmental, agricultural and/or research settings. Such diagnostic use of DsiRNA molecules involves utilizing reconstituted RNAi systems, for example, using cellular lysates or partially purified cellular lysates. DsiRNA molecules of this invention can be used as diagnostic tools to examine genetic drift and mutations within diseased cells. The close relationship between DsiRNA activity and the structure of the target α-1 antitrypsin RNA allows the detection of mutations in a region of the α-1 antitrypsin molecule, which alters the base-pairing and three-dimensional structure of the target α-1 antitrypsin RNA. By using multiple DsiRNA molecules described in this invention, one can map nucleotide changes, which are important to RNA structure and function in vitro, as well as in cells and tissues. Cleavage of target α-1 antitrypsin RNAs with DsiRNA molecules can be used to inhibit gene expression and define the role of specified gene products in the progression of a α-1 antitrypsin-associated disease or disorder. In this manner, other genetic targets can be defined as important mediators of the disease. These experiments will lead to better treatment of the disease progression by affording the possibility of combination therapies (e.g., multiple DsiRNA molecules targeted to different genes, DsiRNA molecules coupled with known small molecule inhibitors, or intermittent treatment with combinations of DsiRNA molecules and/or other chemical or biological molecules). Other in vitro uses of DsiRNA molecules of this invention are well known in the art, and include detection of the presence of RNAs associated with a disease or related condition. Such RNA is detected by determining the presence of a cleavage product after treatment with a DsiRNA using standard methodologies, for example, fluorescence resonance emission transfer (FRET).

In a specific example, DsiRNA molecules that cleave only wild-type or mutant or polymorphic forms of the target α-1 antitrypsin RNA are used for the assay. The first DsiRNA molecules (i.e., those that cleave only wild-type forms of target α-1 antitrypsin RNA) are used to identify wild-type α-1 antitrypsin RNA present in the sample and the second DsiRNA molecules (i.e., those that cleave only mutant or polymorphic forms of target RNA) are used to identify mutant or polymorphic α-1 antitrypsin RNA in the sample.

As reaction controls, synthetic substrates of both wild-type and mutant or polymorphic α-1 antitrypsin RNA are cleaved by both DsiRNA molecules to demonstrate the relative DsiRNA efficiencies in the reactions and the absence of cleavage of the "non-targeted" α-1 antitrypsin RNA species. The cleavage products from the synthetic substrates also serve to generate size markers for the analysis of wild-type and mutant α-1 antitrypsin RNAs in the sample population. Thus, each analysis requires two DsiRNA molecules, two substrates and one unknown sample, which is combined into six reactions. The presence of cleavage products is determined using an RNase protection assay so that full-length and cleavage fragments of each α-1 antitrypsin RNA can be analyzed in one lane of a polyacrylamide gel. It is not absolutely required to quantify the results to gain insight into the expression of mutant or polymorphic α-1 antitrypsin RNAs and putative risk of α-1 antitrypsin-associated phenotypic changes in target cells. The expression of α-1 antitrypsin mRNA whose protein product is implicated in the development of the phenotype (i.e., disease related/associated) is adequate to establish risk. If probes of comparable specific activity are used for both transcripts, then a qualitative comparison of α-1 antitrypsin RNA levels is adequate and decreases the cost of the initial diagnosis. Higher mutant or polymorphic form to wild-type ratios are correlated with higher risk whether α-1 antitrypsin RNA levels are compared qualitatively or quantitatively.

All patents and publications mentioned in the specification are indicative of the levels of skill of those skilled in the art to which the invention pertains. All references cited in this disclosure are incorporated by reference to the same extent as if each reference had been incorporated by reference in its entirety individually.

One skilled in the art would readily appreciate that the present invention is well adapted to carry out the objects and obtain the ends and advantages mentioned, as well as those inherent therein. The methods and compositions described herein as presently representative of preferred embodiments are exemplary and are not intended as limitations on the scope of the invention. Changes therein and other uses will occur to those skilled in the art, which are encompassed within the spirit of the invention, are defined by the scope of the claims.

It will be readily apparent to one skilled in the art that varying substitutions and modifications can be made to the invention disclosed herein without departing from the scope and spirit of the invention. Thus, such additional embodiments are within the scope of the present invention and the following claims. The present invention teaches one skilled in the art to test various combinations and/or substitutions of chemical modifications described herein toward generating nucleic acid constructs with improved activity for mediating RNAi activity. Such improved activity can comprise improved stability, improved bioavailability, and/or improved activation of cellular responses mediating RNAi. Therefore, the specific embodiments described herein are not limiting and one skilled in the art can readily appreciate that specific combinations of the modifications described herein can be tested without undue experimentation toward identifying DsiRNA molecules with improved RNAi activity.

The invention illustratively described herein suitably can be practiced in the absence of any element or elements, limitation or limitations that are not specifically disclosed herein. Thus, for example, in each instance herein any of the terms "comprising", "consisting essentially of", and "consisting of" may be replaced with either of the other two terms. The terms and expressions which have been employed are used as terms of description and not of limitation, and there is no intention that in the use of such terms and expressions of excluding any equivalents of the features shown and described or portions thereof, but it is recognized that various modifications are possible within the scope of the invention claimed. Thus, it should be understood that although the present invention has been specifically disclosed by preferred embodiments, optional features, modification and variation of the concepts herein disclosed may be resorted to by those skilled in the art, and that such modifications and variations are considered to be within the scope of this invention as defined by the description and the appended claims.

In addition, where features or aspects of the invention are described in terms of Markush groups or other grouping of alternatives, those skilled in the art will recognize that the invention is also thereby described in terms of any individual member or subgroup of members of the Markush group or other group.

The use of the terms "a" and "an" and "the" and similar referents in the context of describing the invention (especially in the context of the following claims) are to be construed to cover both the singular and the plural, unless otherwise indicated herein or clearly contradicted by context. The terms "comprising," "having," "including," and "containing" are to be construed as open-ended terms (i.e., meaning "including, but not limited to,") unless otherwise noted. Recitation of ranges of values herein are merely intended to serve as a shorthand method of referring individually to each separate value falling within the range, unless otherwise indicated herein, and each separate value is incorporated into the specification as if it were individually recited herein. All methods described herein can be performed in any suitable order unless otherwise indicated herein or otherwise clearly contradicted by context. The use of any and all examples, or exemplary language (e.g., "such as") provided herein, is intended merely to better illuminate the invention and does not pose a limitation on the scope of the invention unless otherwise claimed. No language in the specification should be construed as indicating any non-claimed element as essential to the practice of the invention.

Embodiments of this invention are described herein, including the best mode known to the inventors for carrying out the invention. Variations of those embodiments may become apparent to those of ordinary skill in the art upon reading the foregoing description.

The inventors expect skilled artisans to employ such variations as appropriate, and the inventors intend for the invention to be practiced otherwise than as specifically described herein. Accordingly, this invention includes all modifications and equivalents of the subject matter recited in the claims appended hereto as permitted by applicable law. Moreover, any combination of the above-described elements in all possible variations thereof is encompassed by the invention unless otherwise indicated herein or otherwise clearly contradicted by context. Those skilled in the art will recognize, or be able to ascertain using no more than routine experimentation, many equivalents to the specific embodiments of the invention described herein. Such equivalents are intended to be encompassed by the following claims.

SEQUENCE LISTING (3499 sequences)

SEQ ID NO: 1 - DNA, 25 bp, Artificial Sequence
  Synthetic oligonucleotide
caucccaccaugaucaggaucaccc

SEQ ID NO: 2 - DNA, 25 bp, Artificial Sequence
  Synthetic oligonucleotide
cagcuggcacaccaguccaacagca

SEQ ID NO: 3 - DNA, 25 bp, Artificial Sequence
  Synthetic oligonucleotide
gcuggcacaccaguccaacagcacc

SEQ ID NO: 4 - DNA, 25 bp, Artificial Sequence
  Synthetic oligonucleotide
ggcacaccaguccaacagcaccaat

SEQ ID NO: 5 - DNA, 25 bp, Artificial Sequence
  Synthetic oligonucleotide
gcacaccaguccaacagcaccaata

SEQ ID NO: 6 - DNA, 25 bp, Artificial Sequence
  Synthetic oligonucleotide
cacaccaguccaacagcaccaauat

SEQ ID NO: 7 - DNA, 25 bp, Artificial Sequence
  Synthetic oligonucleotide
acaccaguccaacagcaccaauatc

SEQ ID NO: 8 - DNA, 25 bp, Artificial Sequence
  Synthetic oligonucleotide
caccaguccaacagcaccaauauct

SEQ ID NO: 9 - DNA, 25 bp, Artificial Sequence
  Synthetic oligonucleotide
ccaauaucuucuucuccccagugag

SEQ ID NO: 10 - DNA, 25 bp, Artificial Sequence
  Synthetic oligonucleotide
caauaucuucuucuccccagugagc

SEQ ID NO: 11 - DNA, 25 bp, Artificial Sequence
  Synthetic oligonucleotide
aauaucuucuucuccccagugagca

SEQ ID NO: 12 - DNA, 25 bp, Artificial Sequence
  Synthetic oligonucleotide
auaucuucuucuccccagugagcat

SEQ ID NO: 13 - DNA, 25 bp, Artificial Sequence
  Synthetic oligonucleotide
uaucuucuucuccccagugagcatc

SEQ ID NO: 14 - DNA, 25 bp, Artificial Sequence
  Synthetic oligonucleotide
aucuucuucuccccagugagcaucg

SEQ ID NO: 15 - DNA, 25 bp, Artificial Sequence
  Synthetic oligonucleotide
ucuucuucuccccagugagcaucgc

SEQ ID NO: 16 - DNA, 25 bp, Artificial Sequence
  Synthetic oligonucleotide
cuucuucuccccagugagcaucgct

SEQ ID NO: 17 - DNA, 25 bp, Artificial Sequence
  Synthetic oligonucleotide
uucuucuccccagugagcaucgcta

SEQ ID NO: 18 - DNA, 25 bp, Artificial Sequence
  Synthetic oligonucleotide
ucuucuccccagugagcaucgcuac

SEQ ID NO: 19 - DNA, 25 bp, Artificial Sequence
  Synthetic oligonucleotide
cuucuccccagugagcaucgcuaca

SEQ ID NO: 20 - DNA, 25 bp, Artificial Sequence
  Synthetic oligonucleotide
ucuccccagugagcaucgcuacagc

SEQ ID NO: 21 - DNA, 25 bp, Artificial Sequence
  Synthetic oligonucleotide
cuccccagugagcaucgcuacagcc

SEQ ID NO: 22 - DNA, 25 bp, Artificial Sequence
  Synthetic oligonucleotide
ccccagugagcaucgcuacagcctt

SEQ ID NO: 23 - DNA, 25 bp, Artificial Sequence
  Synthetic oligonucleotide
acagccuuugcaaugcucucccugg

SEQ ID NO: 24 - DNA, 25 bp, Artificial Sequence
  Synthetic oligonucleotide
ugcaaugcucucccuggggaccaag

SEQ ID NO: 25 - DNA, 25 bp, Artificial Sequence
  Synthetic oligonucleotide
aaauccuggagggccugaauuucaa

SEQ ID NO: 26 - DNA, 25 bp, Artificial Sequence
  Synthetic oligonucleotide
aauccuggagggccugaauuucaac

SEQ ID NO: 27 - DNA, 25 bp, Artificial Sequence
  Synthetic oligonucleotide
auccuggagggccugaauuucaacc

SEQ ID NO: 28 - DNA, 25 bp, Artificial Sequence
  Synthetic oligonucleotide
ccuggagggccugaauuucaacctc

SEQ ID NO: 29 - DNA, 25 bp, Artificial Sequence
  Synthetic oligonucleotide
cuggagggccugaauuucaaccuca

SEQ ID NO: 30 - DNA, 25 bp, Artificial Sequence
  Synthetic oligonucleotide
uggagggccugaauuucaaccucac

SEQ ID NO: 31 - DNA, 25 bp, Artificial Sequence
  Synthetic oligonucleotide
caugaaggcuuccaggaacuccucc

SEQ ID NO: 32 - DNA, 25 bp, Artificial Sequence
  Synthetic oligonucleotide
gaaggcuuccaggaacuccuccgta

SEQ ID NO: 33 - DNA, 25 bp, Artificial Sequence
  Synthetic oligonucleotide
aaggcuuccaggaacuccuccguac

SEQ ID NO: 34 - DNA, 25 bp, Artificial Sequence
  Synthetic oligonucleotide
agccagacagccagcuccagcugac

SEQ ID NO: 35 - DNA, 25 bp, Artificial Sequence
  Synthetic oligonucleotide
ccagacagccagcuccagcugacca

SEQ ID NO: 36 - DNA, 25 bp, Artificial Sequence
  Synthetic oligonucleotide
agacagccagcuccagcugaccacc

SEQ ID NO: 37 - DNA, 25 bp, Artificial Sequence
  Synthetic oligonucleotide
gacagccagcuccagcugaccaccg

SEQ ID NO: 38 - DNA, 25 bp, Artificial Sequence
  Synthetic oligonucleotide
uaguggauaaguuuuuggaggaugt

SEQ ID NO: 39 - DNA, 25 bp, Artificial Sequence
  Synthetic oligonucleotide
aguggauaaguuuuuggaggaugtt

SEQ ID NO: 40 - DNA, 25 bp, Artificial Sequence
  Synthetic oligonucleotide
guggauaaguuuuuggaggauguta

SEQ ID NO: 41 - DNA, 25 bp, Artificial Sequence
  Synthetic oligonucleotide
uggauaaguuuuuggaggauguuaa

SEQ ID NO: 42 - DNA, 25 bp, Artificial Sequence
  Synthetic oligonucleotide
ggauaaguuuuuggaggauguuaaa

SEQ ID NO: 43 - DNA, 25 bp, Artificial Sequence
  Synthetic oligonucleotide
gauaaguuuuuggaggauguuaaaa

SEQ ID NO: 44 - DNA, 25 bp, Artificial Sequence
  Synthetic oligonucleotide
auaaguuuuuggaggauguuaaaaa

SEQ ID NO: 45 - DNA, 25 bp, Artificial Sequence
  Synthetic oligonucleotide
uguaccacucagaagccuucacugt

SEQ ID NO: 46 - DNA, 25 bp, Artificial Sequence
  Synthetic oligonucleotide
guaccacucagaagccuucacugtc

SEQ ID NO: 47 - DNA, 25 bp, Artificial Sequence
  Synthetic oligonucleotide
acucaagggaaaauuguggauuugg

SEQ ID NO: 48 - DNA, 25 bp, Artificial Sequence
  Synthetic oligonucleotide
cucaagggaaaauuguggauuuggt

SEQ ID NO: 49 - DNA, 25 bp, Artificial Sequence
  Synthetic oligonucleotide
ucaagggaaaauuguggauuuggtc

SEQ ID NO: 50 - DNA, 25 bp, Artificial Sequence
  Synthetic oligonucleotide
caagggaaaauuguggauuugguca

SEQ ID NO: 51 - DNA, 25 bp, Artificial Sequence
  Synthetic oligonucleotide
aagggaaaauuguggauuuggucaa

SEQ ID NO: 52 - DNA, 25 bp, Artificial Sequence
  Synthetic oligonucleotide
agggaaaauuguggauuuggucaag

SEQ ID NO: 53 - DNA, 25 bp, Artificial Sequence
  Synthetic oligonucleotide
gggaaaauuguggauuuggucaagg

SEQ ID NO: 54 - DNA, 25 bp, Artificial Sequence
  Synthetic oligonucleotide
ggaaaauuguggauuuggucaagga

SEQ ID NO: 55 - DNA, 25 bp, Artificial Sequence
  Synthetic oligonucleotide
gaaaauuguggauuuggucaaggag

SEQ ID NO: 56 - DNA, 25 bp, Artificial Sequence
  Synthetic oligonucleotide
aaaauuguggauuuggucaaggagc

SEQ ID NO: 57 - DNA, 25 bp, Artificial Sequence
  Synthetic oligonucleotide
aaauuguggauuuggucaaggagct

SEQ ID NO: 58 - DNA, 25 bp, Artificial Sequence
  Synthetic oligonucleotide
aauuguggauuuggucaaggagctt

SEQ ID NO: 59 - DNA, 25 bp, Artificial Sequence
  Synthetic oligonucleotide
auuguggauuuggucaaggagcutg

SEQ ID NO: 60 - DNA, 25 bp, Artificial Sequence
  Synthetic oligonucleotide
uuguggauuuggucaaggagcuuga

SEQ ID NO: 61 - DNA, 25 bp, Artificial Sequence
  Synthetic oligonucleotide
uguggauuuggucaaggagcuugac

SEQ ID NO: 62 - DNA, 25 bp, Artificial Sequence
  Synthetic oligonucleotide
guggauuuggucaaggagcuugaca

SEQ ID NO: 63 - DNA, 25 bp, Artificial Sequence
  Synthetic oligonucleotide
uggauuuggucaaggagcuugacag

SEQ ID NO: 64 - DNA, 25 bp, Artificial Sequence
  Synthetic oligonucleotide
ggauuuggucaaggagcuugacaga

SEQ ID NO: 65 - DNA, 25 bp, Artificial Sequence
  Synthetic oligonucleotide
gauuuggucaaggagcuugacagag

SEQ ID NO: 66 - DNA, 25 bp, Artificial Sequence
  Synthetic oligonucleotide
auuuggucaaggagcuugacagaga

SEQ ID NO: 67 - DNA, 25 bp, Artificial Sequence
  Synthetic oligonucleotide
uuuggucaaggagcuugacagagac

SEQ ID NO: 68 - DNA, 25 bp, Artificial Sequence
  Synthetic oligonucleotide
uuggucaaggagcuugacagagaca

SEQ ID NO: 69 - DNA, 25 bp, Artificial Sequence
  Synthetic oligonucleotide
uggucaaggagcuugacagagacac

SEQ ID NO: 70 - DNA, 25 bp, Artificial Sequence
  Synthetic oligonucleotide
caguuuuugcucuggugaauuacat

SEQ ID NO: 71 - DNA, 25 bp, Artificial Sequence
  Synthetic oligonucleotide
aguuuuugcucuggugaauuacatc

SEQ ID NO: 72 - DNA, 25 bp, Artificial Sequence
  Synthetic oligonucleotide
guuuuugcucuggugaauuacauct

SEQ ID NO: 73 - DNA, 25 bp, Artificial Sequence
  Synthetic oligonucleotide
uuuuugcucuggugaauuacauctt

SEQ ID NO: 74 - DNA, 25 bp, Artificial Sequence
  Synthetic oligonucleotide
aaaggcaaaugggagagacccuutg

SEQ ID NO: 75 - DNA, 25 bp, Artificial Sequence
  Synthetic oligonucleotide
aaggcaaaugggagagacccuuuga

SEQ ID NO: 76 - DNA, 25 bp, Artificial Sequence
  Synthetic oligonucleotide
aggcaaaugggagagacccuuugaa

SEQ ID NO: 77 - DNA, 25 bp, Artificial Sequence
  Synthetic oligonucleotide
ggcaaaugggagagacccuuugaag

SEQ ID NO: 78 - DNA, 25 bp, Artificial Sequence
  Synthetic oligonucleotide
aggaagaggacuuccacguggacca

SEQ ID NO: 79 - DNA, 25 bp, Artificial Sequence
  Synthetic oligonucleotide
ggaagaggacuuccacguggaccag

SEQ ID NO: 80 - DNA, 25 bp, Artificial Sequence
  Synthetic oligonucleotide
gaagaggacuuccacguggaccagg

SEQ ID NO: 81 - DNA, 25 bp, Artificial Sequence
  Synthetic oligonucleotide
aagaggacuuccacguggaccaggt

SEQ ID NO: 82 - DNA, 25 bp, Artificial Sequence
  Synthetic oligonucleotide
gaggacuuccacguggaccagguga

SEQ ID NO: 83 - DNA, 25 bp, Artificial Sequence
  Synthetic oligonucleotide
aggacuuccacguggaccaggugac

SEQ ID NO: 84 - DNA, 25 bp, Artificial Sequence
  Synthetic oligonucleotide
gacuuccacguggaccaggugacca

SEQ ID NO: 85 - DNA, 25 bp, Artificial Sequence
  Synthetic oligonucleotide
guuuaggcauguuuaacauccagca

SEQ ID NO: 86 - DNA, 25 bp, Artificial Sequence
  Synthetic oligonucleotide
uuuaggcauguuuaacauccagcac

SEQ ID NO: 87 - DNA, 25 bp, Artificial Sequence
  Synthetic oligonucleotide
gcuguccagcugggugcugcugatg

SEQ ID NO: 88 - DNA, 25 bp, Artificial Sequence
  Synthetic oligonucleotide
cuguccagcugggugcugcugauga

SEQ ID NO: 89 - DNA, 25 bp, Artificial Sequence
  Synthetic oligonucleotide
caaugccaccgccaucuucuucctg

SEQ ID NO: 90 - DNA, 25 bp, Artificial Sequence
  Synthetic oligonucleotide
aaugccaccgccaucuucuuccugc

SEQ ID NO: 91 - DNA, 25 bp, Artificial Sequence
  Synthetic oligonucleotide
ccaccgccaucuucuuccugccuga

SEQ ID NO: 92 - DNA, 25 bp, Artificial Sequence
  Synthetic oligonucleotide
caccgccaucuucuuccugccugat

SEQ ID NO: 93 - DNA, 25 bp, Artificial Sequence
  Synthetic oligonucleotide
accgccaucuucuuccugccugatg

SEQ ID NO: 94 - DNA, 25 bp, Artificial Sequence
  Synthetic oligonucleotide
ccgccaucuucuuccugccugauga

SEQ ID NO: 95 - DNA, 25 bp, Artificial Sequence
  Synthetic oligonucleotide
cgccaucuucuuccugccugaugag

SEQ ID NO: 96 - DNA, 25 bp, Artificial Sequence
  Synthetic oligonucleotide
gccaucuucuuccugccugaugagg

SEQ ID NO: 97 - DNA, 25 bp, Artificial Sequence
  Synthetic oligonucleotide
aucuucuuccugccugaugagggga

SEQ ID NO: 98 - DNA, 25 bp, Artificial Sequence
  Synthetic oligonucleotide
cuuccugccugaugaggggaaacta

SEQ ID NO: 99 - DNA, 25 bp, Artificial Sequence
  Synthetic oligonucleotide
uuccugccugaugaggggaaacuac

SEQ ID NO: 100 - DNA, 25 bp, Artificial Sequence
  Synthetic oligonucleotide
uccugccugaugaggggaaacuaca

SEQ ID NO: 101 - DNA, 25 bp, Artificial Sequence
  Synthetic oligonucleotide
ccugccugaugaggggaaacuacag

SEQ ID NO: 102 - DNA, 25 bp, Artificial Sequence
  Synthetic oligonucleotide
cugccugaugaggggaaacuacagc

SEQ ID NO: 103 - DNA, 25 bp, Artificial Sequence
  Synthetic oligonucleotide
ugccugaugaggggaaacuacagca

SEQ ID NO: 104 - DNA, 25 bp, Artificial Sequence
  Synthetic oligonucleotide
agcaccuggaaaaugaacucaccca

SEQ ID NO: 105 - DNA, 25 bp, Artificial Sequence
  Synthetic oligonucleotide
gcaccuggaaaaugaacucacccac

SEQ ID NO: 106 - DNA, 25 bp, Artificial Sequence
  Synthetic oligonucleotide
caccuggaaaaugaacucacccacg

SEQ ID NO: 107 - DNA, 25 bp, Artificial Sequence
  Synthetic oligonucleotide
accuggaaaaugaacucacccacga

SEQ ID NO: 108 - DNA, 25 bp, Artificial Sequence
  Synthetic oligonucleotide
ccuggaaaaugaacucacccacgat

SEQ ID NO: 109 - DNA, 25 bp, Artificial Sequence
  Synthetic oligonucleotide
auaucaucaccaaguuccuggaaaa

SEQ ID NO: 110 - DNA, 25 bp, Artificial Sequence
  Synthetic oligonucleotide
uaucaucaccaaguuccuggaaaat

SEQ ID NO: 111 - DNA, 25 bp, Artificial Sequence
  Synthetic oligonucleotide
aucaucaccaaguuccuggaaaatg

SEQ ID NO: 112 - DNA, 25 bp, Artificial Sequence
  Synthetic oligonucleotide
ucaucaccaaguuccuggaaaauga

SEQ ID NO: 113 - DNA, 25 bp, Artificial Sequence
  Synthetic oligonucleotide
caucaccaaguuccuggaaaaugaa

SEQ ID NO: 114 - DNA, 25 bp, Artificial Sequence
  Synthetic oligonucleotide
aucaccaaguuccuggaaaaugaag

SEQ ID NO: 115 - DNA, 25 bp, Artificial Sequence
  Synthetic oligonucleotide
ucaccaaguuccuggaaaaugaaga

SEQ ID NO: 116 - DNA, 25 bp, Artificial Sequence
  Synthetic oligonucleotide
caccaaguuccuggaaaaugaagac

SEQ ID NO: 117 - DNA, 25 bp, Artificial Sequence
  Synthetic oligonucleotide
accaaguuccuggaaaaugaagaca

SEQ ID NO: 118 - DNA, 25 bp, Artificial Sequence
  Synthetic oligonucleotide
ccaaguuccuggaaaaugaagacag

SEQ ID NO: 119 - DNA, 25 bp, Artificial Sequence
  Synthetic oligonucleotide
aggucuucagcaauggggcugacct

SEQ ID NO: 120 - DNA, 25 bp, Artificial Sequence
  Synthetic oligonucleotide
caauggggcugaccucuccggggtc

SEQ ID NO: 121 - DNA, 25 bp, Artificial Sequence
  Synthetic oligonucleotide
aauggggcugaccucuccgggguca

SEQ ID NO: 122 - DNA, 25 bp, Artificial Sequence
  Synthetic oligonucleotide
auggggcugaccucuccggggucac

SEQ ID NO: 123 - DNA, 25 bp, Artificial Sequence
  Synthetic oligonucleotide
gaggaggcaccccugaagcucucca

SEQ ID NO: 124 - DNA, 25 bp, Artificial Sequence
  Synthetic oligonucleotide
ggaggcaccccugaagcucuccaag

SEQ ID NO: 125 - DNA, 25 bp, Artificial Sequence
  Synthetic oligonucleotide
cugaagcucuccaaggccgugcata

SEQ ID NO: 126 - DNA, 25 bp, Artificial Sequence
  Synthetic oligonucleotide
cgugcauaaggcugugcugaccatc

SEQ ID NO: 127 - DNA, 25 bp, Artificial Sequence
  Synthetic oligonucleotide
gugcauaaggcugugcugaccaucg

SEQ ID NO: 128 - DNA, 25 bp, Artificial Sequence
  Synthetic oligonucleotide
ugcauaaggcugugcugaccaucga

SEQ ID NO: 129 - DNA, 25 bp, Artificial Sequence
  Synthetic oligonucleotide
gcauaaggcugugcugaccaucgac

SEQ ID NO: 130 - DNA, 25 bp, Artificial Sequence
  Synthetic oligonucleotide
cauaaggcugugcugaccaucgacg

SEQ ID NO: 131 - DNA, 25 bp, Artificial Sequence
  Synthetic oligonucleotide
auaaggcugugcugaccaucgacga

SEQ ID NO: 132 - DNA, 25 bp, Artificial Sequence
  Synthetic oligonucleotide
uaaggcugugcugaccaucgacgag

SEQ ID NO: 133 - DNA, 25 bp, Artificial Sequence
  Synthetic oligonucleotide
aaggcugugcugaccaucgacgaga

SEQ ID NO: 134 - DNA, 25 bp, Artificial Sequence
  Synthetic oligonucleotide
aggcugugcugaccaucgacgagaa

SEQ ID NO: 135 - DNA, 25 bp, Artificial Sequence
  Synthetic oligonucleotide
acugaagcugcuggggccauguutt

SEQ ID NO: 136 - DNA, 25 bp, Artificial Sequence
  Synthetic oligonucleotide
cugaagcugcuggggccauguuutt

SEQ ID NO: 137 - DNA, 25 bp, Artificial Sequence
  Synthetic oligonucleotide
ugaagcugcuggggccauguuuuta

SEQ ID NO: 138 - DNA, 25 bp, Artificial Sequence
  Synthetic oligonucleotide
gaagcugcuggggccauguuuuuag

SEQ ID NO: 139 - DNA, 25 bp, Artificial Sequence
  Synthetic oligonucleotide
aagcugcuggggccauguuuuuaga

SEQ ID NO: 140 - DNA, 25 bp, Artificial Sequence
  Synthetic oligonucleotide
agcugcuggggccauguuuuuagag

SEQ ID NO: 141 - DNA, 25 bp, Artificial Sequence
  Synthetic oligonucleotide
gccauguuuuuagaggccauaccca

SEQ ID NO: 142 - DNA, 25 bp, Artificial Sequence
  Synthetic oligonucleotide
ccauguuuuuagaggccauacccat

SEQ ID NO: 143 - DNA, 25 bp, Artificial Sequence
  Synthetic oligonucleotide
cauguuuuuagaggccauacccatg

SEQ ID NO: 144 - DNA, 25 bp, Artificial Sequence
  Synthetic oligonucleotide
auguuuuuagaggccauacccaugt

SEQ ID NO: 145 - DNA, 25 bp, Artificial Sequence
  Synthetic oligonucleotide
uguuuuuagaggccauacccaugtc

SEQ ID NO: 146 - DNA, 25 bp, Artificial Sequence
  Synthetic oligonucleotide
guuuuuagaggccauacccauguct

SEQ ID NO: 147 - DNA, 25 bp, Artificial Sequence
  Synthetic oligonucleotide
uuuuuagaggccauacccaugucta

SEQ ID NO: 148 - DNA, 25 bp, Artificial Sequence
  Synthetic oligonucleotide
uuuuagaggccauacccaugucuat

SEQ ID NO: 149 - DNA, 25 bp, Artificial Sequence
  Synthetic oligonucleotide
uuuagaggccauacccaugucuatc

SEQ ID NO: 150 - DNA, 25 bp, Artificial Sequence
  Synthetic oligonucleotide
uuagaggccauacccaugucuaucc

SEQ ID NO: 151 - DNA, 25 bp, Artificial Sequence
  Synthetic oligonucleotide
uagaggccauacccaugucuauccc

SEQ ID NO: 152 - DNA, 25 bp, Artificial Sequence
  Synthetic oligonucleotide
agaggccauacccaugucuaucccc

SEQ ID NO: 153 - DNA, 25 bp, Artificial Sequence
  Synthetic oligonucleotide
guucaacaaacccuuugucuucuta

SEQ ID NO: 154 - DNA, 25 bp, Artificial Sequence
  Synthetic oligonucleotide
uucaacaaacccuuugucuucuuaa

SEQ ID NO: 155 - DNA, 25 bp, Artificial Sequence
  Synthetic oligonucleotide
ucaacaaacccuuugucuucuuaat

SEQ ID NO: 156 - DNA, 25 bp, Artificial Sequence
  Synthetic oligonucleotide
caacaaacccuuugucuucuuaatg

SEQ ID NO: 157 - DNA, 25 bp, Artificial Sequence
  Synthetic oligonucleotide
aacaaacccuuugucuucuuaauga

SEQ ID NO: 158 - DNA, 25 bp, Artificial Sequence
  Synthetic oligonucleotide
acaaacccuuugucuucuuaaugat

SEQ ID NO: 159 - DNA, 25 bp, Artificial Sequence
  Synthetic oligonucleotide
caaacccuuugucuucuuaaugatt

SEQ ID NO: 160 - DNA, 25 bp, Artificial Sequence
  Synthetic oligonucleotide
aaacccuuugucuucuuaaugautg

SEQ ID NO: 161 - DNA, 25 bp, Artificial Sequence
  Synthetic oligonucleotide
aacccuuugucuucuuaaugauuga

SEQ ID NO: 162 - DNA, 25 bp, Artificial Sequence
  Synthetic oligonucleotide
aauaccaagucuccccucuucaugg

SEQ ID NO: 163 - DNA, 25 bp, Artificial Sequence
  Synthetic oligonucleotide
auaccaagucuccccucuucauggg

SEQ ID NO: 164 - DNA, 25 bp, Artificial Sequence
  Synthetic oligonucleotide
uaccaagucuccccucuucauggga

SEQ ID NO: 165 - DNA, 25 bp, Artificial Sequence
  Synthetic oligonucleotide
accaagucuccccucuucaugggaa

SEQ ID NO: 166 - DNA, 25 bp, Artificial Sequence
  Synthetic oligonucleotide
ccaagucuccccucuucaugggaaa

SEQ ID NO: 167 - DNA, 25 bp, Artificial Sequence
  Synthetic oligonucleotide
caagucuccccucuucaugggaaaa

SEQ ID NO: 168 - DNA, 25 bp, Artificial Sequence
  Synthetic oligonucleotide
aagucuccccucuucaugggaaaag

SEQ ID NO: 169 - DNA, 25 bp, Artificial Sequence
  Synthetic oligonucleotide
agucuccccucuucaugggaaaagt

SEQ ID NO: 170 - DNA, 25 bp, Artificial Sequence
  Synthetic oligonucleotide
gucuccccucuucaugggaaaagtg

SEQ ID NO: 171 - DNA, 25 bp, Artificial Sequence
  Synthetic oligonucleotide
cuccccucuucaugggaaaaguggt

SEQ ID NO: 172 - DNA, 25 bp, Artificial Sequence
  Synthetic oligonucleotide
ccccucuucaugggaaaagugguga

SEQ ID NO: 173 - DNA, 25 bp, Artificial Sequence
  Synthetic oligonucleotide
cccucuucaugggaaaaguggugaa

SEQ ID NO: 174 - DNA, 25 bp, Artificial Sequence
  Synthetic oligonucleotide
ccucuucaugggaaaaguggugaat

SEQ ID NO: 175 - DNA, 25 bp, Artificial Sequence
  Synthetic oligonucleotide
cucuucaugggaaaaguggugaatc

SEQ ID NO: 176 - DNA, 25 bp, Artificial Sequence
  Synthetic oligonucleotide
ucuucaugggaaaaguggugaaucc

SEQ ID NO: 177 - DNA, 25 bp, Artificial Sequence
  Synthetic oligonucleotide
cuucaugggaaaaguggugaauccc

SEQ ID NO: 178 - DNA, 25 bp, Artificial Sequence
  Synthetic oligonucleotide
uucaugggaaaaguggugaauccca

SEQ ID NO: 179 - DNA, 25 bp, Artificial Sequence
  Synthetic oligonucleotide
ucaugggaaaaguggugaaucccac

SEQ ID NO: 180 - DNA, 25 bp, Artificial Sequence
  Synthetic oligonucleotide
caugggaaaaguggugaaucccacc

SEQ ID NO: 181 - DNA, 25 bp, Artificial Sequence
  Synthetic oligonucleotide
augggaaaaguggugaaucccaccc

SEQ ID NO: 182 - DNA, 25 bp, Artificial Sequence
  Synthetic oligonucleotide
ugggaaaaguggugaaucccaccca

SEQ ID NO: 183 - DNA, 25 bp, Artificial Sequence
  Synthetic oligonucleotide
gggaaaaguggugaaucccacccaa

SEQ ID NO: 184 - DNA, 25 bp, Artificial Sequence
  Synthetic oligonucleotide
ggaaaaguggugaaucccacccaaa

SEQ ID NO: 185 - DNA, 25 bp, Artificial Sequence
  Synthetic oligonucleotide
gaaaaguggugaaucccacccaaaa

SEQ ID NO: 186 - DNA, 25 bp, Artificial Sequence
  Synthetic oligonucleotide
aaaaguggugaaucccacccaaaaa

SEQ ID NO: 187 - DNA, 25 bp, Artificial Sequence
  Synthetic oligonucleotide
aaaguggugaaucccacccaaaaat

SEQ ID NO: 188 - DNA, 25 bp, Artificial Sequence
  Synthetic oligonucleotide
aaguggugaaucccacccaaaaata

SEQ ID NO: 189 - DNA, 25 bp, Artificial Sequence
  Synthetic oligonucleotide
cgauaguucaaaauggugaaauuag

SEQ ID NO: 190 - DNA, 25 bp, Artificial Sequence
  Synthetic oligonucleotide
caaaauggugaaauuagcaauucta

SEQ ID NO: 191 - DNA, 25 bp, Artificial Sequence
  Synthetic oligonucleotide
uugguaugauguucaaguuagauaa

SEQ ID NO: 192 - DNA, 25 bp, Artificial Sequence
  Synthetic oligonucleotide
gguaugauguucaaguuagauaaca

SEQ ID NO: 193 - DNA, 25 bp, Artificial Sequence
  Synthetic oligonucleotide
guaugauguucaaguuagauaacaa

SEQ ID NO: 194 - DNA, 25 bp, Artificial Sequence
  Synthetic oligonucleotide
augauguucaaguuagauaacaaaa

SEQ ID NO: 195 - DNA, 25 bp, Artificial Sequence
  Synthetic oligonucleotide
auguucaaguuagauaacaaaaugt

SEQ ID NO: 196 - DNA, 25 bp, Artificial Sequence
  Synthetic oligonucleotide
caaguuagauaacaaaauguuuata

SEQ ID NO: 197 - DNA, 25 bp, Artificial Sequence
  Synthetic oligonucleotide
aaguuagauaacaaaauguuuauac

SEQ ID NO: 198 - DNA, 25 bp, Artificial Sequence
  Synthetic oligonucleotide
aguuagauaacaaaauguuuauacc

SEQ ID NO: 199 - RNA, 27 nt, Artificial Sequence
  Synthetic oligonucleotide
gggugauccugaucauggugggaugua

SEQ ID NO: 200 - RNA, 27 nt, Artificial Sequence
  Synthetic oligonucleotide
ugcuguuggacuggugugccagcuggc

SEQ ID NO: 201 - RNA, 27 nt, Artificial Sequence
  Synthetic oligonucleotide
ggugcuguuggacuggugugccagcug

SEQ ID NO: 202 - RNA, 27 nt, Artificial Sequence
  Synthetic oligonucleotide
auuggugcuguuggacuggugugccag

SEQ ID NO: 203 - RNA, 27 nt, Artificial Sequence
  Synthetic oligonucleotide
uauuggugcuguuggacuggugugcca

SEQ ID NO: 204 - RNA, 27 nt, Artificial Sequence
  Synthetic oligonucleotide
auauuggugcuguuggacuggugugcc

SEQ ID NO: 205 - RNA, 27 nt, Artificial Sequence
  Synthetic oligonucleotide
gauauuggugcuguuggacuggugugc

SEQ ID NO: 206 - RNA, 27 nt, Artificial Sequence
  Synthetic oligonucleotide
agauauuggugcuguuggacuggugug

SEQ ID NO: 207 - RNA, 27 nt, Artificial Sequence
  Synthetic oligonucleotide
cucacuggggagaagaagauauuggug

SEQ ID NO: 208 - RNA, 27 nt, Artificial Sequence
  Synthetic oligonucleotide
gcucacuggggagaagaagauauuggu

SEQ ID NO: 209 - RNA, 27 nt, Artificial Sequence
  Synthetic oligonucleotide
ugcucacuggggagaagaagauauugg

SEQ ID NO: 210 - RNA, 27 nt, Artificial Sequence
  Synthetic oligonucleotide
augcucacuggggagaagaagauauug

SEQ ID NO: 211 - RNA, 27 nt, Artificial Sequence
  Synthetic oligonucleotide
gaugcucacuggggagaagaagauauu

SEQ ID NO: 212 - RNA, 27 nt, Artificial Sequence
  Synthetic oligonucleotide
cgaugcucacuggggagaagaagauau

SEQ ID NO: 213 - RNA, 27 nt, Artificial Sequence
  Synthetic oligonucleotide
gcgaugcucacuggggagaagaagaua

SEQ ID NO: 214 - RNA, 27 nt, Artificial Sequence
  Synthetic oligonucleotide
agcgaugcucacuggggagaagaagau

SEQ ID NO: 215 - RNA, 27 nt, Artificial Sequence
  Synthetic oligonucleotide
uagcgaugcucacuggggagaagaaga

SEQ ID NO: 216 - RNA, 27 nt, Artificial Sequence
  Synthetic oligonucleotide
guagcgaugcucacuggggagaagaag

SEQ ID NO: 217 - RNA, 27 nt, Artificial Sequence
  Synthetic oligonucleotide
uguagcgaugcucacuggggagaagaa

SEQ ID NO: 218 - RNA, 27 nt, Artificial Sequence
  Synthetic oligonucleotide
gcuguagcgaugcucacuggggagaag

SEQ ID NO: 219 - RNA, 27 nt, Artificial Sequence
  Synthetic oligonucleotide
ggcuguagcgaugcucacuggggagaa

SEQ ID NO: 220 - RNA, 27 nt, Artificial Sequence
  Synthetic oligonucleotide
aaggcuguagcgaugcucacuggggag

SEQ ID NO: 221 - RNA, 27 nt, Artificial Sequence
  Synthetic oligonucleotide
ccagggagagcauugcaaaggcuguag

SEQ ID NO: 222 - RNA, 27 nt, Artificial Sequence
  Synthetic oligonucleotide
cuugguccccagggagagcauugcaaa

SEQ ID NO: 223 - RNA, 27 nt, Artificial Sequence
  Synthetic oligonucleotide
uugaaauucaggcccuccaggauuuca

SEQ ID NO: 224 - RNA, 27 nt, Artificial Sequence
  Synthetic oligonucleotide
guugaaauucaggcccuccaggauuuc

SEQ ID NO: 225 - RNA, 27 nt, Artificial Sequence
  Synthetic oligonucleotide
gguugaaauucaggcccuccaggauuu

SEQ ID NO: 226 - RNA, 27 nt, Artificial Sequence
  Synthetic oligonucleotide
gagguugaaauucaggcccuccaggau

SEQ ID NO: 227 - RNA, 27 nt, Artificial Sequence
  Synthetic oligonucleotide
ugagguugaaauucaggcccuccagga

SEQ ID NO: 228 - RNA, 27 nt, Artificial Sequence
  Synthetic oligonucleotide
gugagguugaaauucaggcccuccagg

SEQ ID NO: 229 - RNA, 27 nt, Artificial Sequence
  Synthetic oligonucleotide
ggaggaguuccuggaagccuucaugga

SEQ ID NO: 230 - RNA, 27 nt, Artificial Sequence
  Synthetic oligonucleotide
uacggaggaguuccuggaagccuucau

SEQ ID NO: 231 - RNA, 27 nt, Artificial Sequence
  Synthetic oligonucleotide
guacggaggaguuccuggaagccuuca

SEQ ID NO: 232 - RNA, 27 nt, Artificial Sequence
  Synthetic oligonucleotide
gucagcuggagcuggcugucuggcugg

SEQ ID NO: 233 - RNA, 27 nt, Artificial Sequence
  Synthetic oligonucleotide
uggucagcuggagcuggcugucuggcu

SEQ ID NO: 234 - RNA, 27 nt, Artificial Sequence
  Synthetic oligonucleotide
gguggucagcuggagcuggcugucugg

SEQ ID NO: 235 - RNA, 27 nt, Artificial Sequence
  Synthetic oligonucleotide
cgguggucagcuggagcuggcugucug

SEQ ID NO: 236 - RNA, 27 nt, Artificial Sequence
  Synthetic oligonucleotide
acauccuccaaaaacuuauccacuagc

SEQ ID NO: 237 - RNA, 27 nt, Artificial Sequence
  Synthetic oligonucleotide
aacauccuccaaaaacuuauccacuag

SEQ ID NO: 238 - RNA, 27 nt, Artificial Sequence
  Synthetic oligonucleotide
uaacauccuccaaaaacuuauccacua

SEQ ID NO: 239 - RNA, 27 nt, Artificial Sequence
  Synthetic oligonucleotide
uuaacauccuccaaaaacuuauccacu

SEQ ID NO: 240 - RNA, 27 nt, Artificial Sequence
  Synthetic oligonucleotide
uuuaacauccuccaaaaacuuauccac

SEQ ID NO: 241 - RNA, 27 nt, Artificial Sequence
  Synthetic oligonucleotide
uuuuaacauccuccaaaaacuuaucca

SEQ ID NO: 242 - RNA, 27 nt, Artificial Sequence
  Synthetic oligonucleotide
uuuuuaacauccuccaaaaacuuaucc

SEQ ID NO: 243 - RNA, 27 nt, Artificial Sequence
  Synthetic oligonucleotide
acagugaaggcuucugagugguacaac

SEQ ID NO: 244 - RNA, 27 nt, Artificial Sequence
  Synthetic oligonucleotide
gacagugaaggcuucugagugguacaa

SEQ ID NO: 245 - RNA, 27 nt, Artificial Sequence
  Synthetic oligonucleotide
ccaaauccacaauuuucccuugaguac

SEQ ID NO: 246 - RNA, 27 nt, Artificial Sequence
  Synthetic oligonucleotide
accaaauccacaauuuucccuugagua

SEQ ID NO: 247 - RNA, 27 nt, Artificial Sequence
  Synthetic oligonucleotide
gaccaaauccacaauuuucccuugagu

SEQ ID NO: 248 - RNA, 27 nt, Artificial Sequence
  Synthetic oligonucleotide
ugaccaaauccacaauuuucccuugag

SEQ ID NO: 249 - RNA, 27 nt, Artificial Sequence
  Synthetic oligonucleotide
uugaccaaauccacaauuuucccuuga

SEQ ID NO: 250 - RNA, 27 nt, Artificial Sequence
  Synthetic oligonucleotide
cuugaccaaauccacaauuuucccuug

SEQ ID NO: 251 - RNA, 27 nt, Artificial Sequence
  Synthetic oligonucleotide
ccuugaccaaauccacaauuuucccuu

SEQ ID NO: 252 - RNA, 27 nt, Artificial Sequence
  Synthetic oligonucleotide
uccuugaccaaauccacaauuuucccu

SEQ ID NO: 253 - RNA, 27 nt, Artificial Sequence
  Synthetic oligonucleotide
cuccuugaccaaauccacaauuuuccc

SEQ ID NO: 254 - RNA, 27 nt, Artificial Sequence
  Synthetic oligonucleotide
gcuccuugaccaaauccacaauuuucc

SEQ ID NO: 255 - RNA, 27 nt, Artificial Sequence
  Synthetic oligonucleotide
agcuccuugaccaaauccacaauuuuc

SEQ ID NO: 256 - RNA, 27 nt, Artificial Sequence
  Synthetic oligonucleotide
aagcuccuugaccaaauccacaauuuu

SEQ ID NO: 257 - RNA, 27 nt, Artificial Sequence
  Synthetic oligonucleotide
caagcuccuugaccaaauccacaauuu

SEQ ID NO: 258 - RNA, 27 nt, Artificial Sequence
  Synthetic oligonucleotide
ucaagcuccuugaccaaauccacaauu

SEQ ID NO: 259 - RNA, 27 nt, Artificial Sequence
  Synthetic oligonucleotide
gucaagcuccuugaccaaauccacaau

SEQ ID NO: 260 - RNA, 27 nt, Artificial Sequence
  Synthetic oligonucleotide
ugucaagcuccuugaccaaauccacaa

SEQ ID NO: 261 - RNA, 27 nt, Artificial Sequence
  Synthetic oligonucleotide
cugucaagcuccuugaccaaauccaca

SEQ ID NO: 262 - RNA, 27 nt, Artificial Sequence
  Synthetic oligonucleotide
ucugucaagcuccuugaccaaauccac

SEQ ID NO: 263 - RNA, 27 nt, Artificial Sequence
  Synthetic oligonucleotide
cucugucaagcuccuugaccaaaucca

SEQ ID NO: 264 - RNA, 27 nt, Artificial Sequence
  Synthetic oligonucleotide
ucucugucaagcuccuugaccaaaucc

SEQ ID NO: 265 - RNA, 27 nt, Artificial Sequence
  Synthetic oligonucleotide
gucucugucaagcuccuugaccaaauc

SEQ ID NO: 266 - RNA, 27 nt, Artificial Sequence
  Synthetic oligonucleotide
ugucucugucaagcuccuugaccaaau

SEQ ID NO: 267 - RNA, 27 nt, Artificial Sequence
  Synthetic oligonucleotide
gugucucugucaagcuccuugaccaaa

SEQ ID NO: 268 - RNA, 27 nt, Artificial Sequence
  Synthetic oligonucleotide
auguaauucaccagagcaaaaacugug

SEQ ID NO: 269 - RNA, 27 nt, Artificial Sequence
  Synthetic oligonucleotide
gauguaauucaccagagcaaaaacugu

SEQ ID NO: 270 - RNA, 27 nt, Artificial Sequence
  Synthetic oligonucleotide
agauguaauucaccagagcaaaaacug

SEQ ID NO: 271 - RNA, 27 nt, Artificial Sequence
  Synthetic oligonucleotide
aagauguaauucaccagagcaaaaacu

SEQ ID NO: 272 - RNA, 27 nt, Artificial Sequence
  Synthetic oligonucleotide
caaagggucucucccauuugccuuuaa

SEQ ID NO: 273 - RNA, 27 nt, Artificial Sequence
  Synthetic oligonucleotide
ucaaagggucucucccauuugccuuua

SEQ ID NO: 274 - RNA, 27 nt, Artificial Sequence
  Synthetic oligonucleotide
uucaaagggucucucccauuugccuuu

SEQ ID NO: 275 - RNA, 27 nt, Artificial Sequence
  Synthetic oligonucleotide
cuucaaagggucucucccauuugccuu

SEQ ID NO: 276 - RNA, 27 nt, Artificial Sequence
  Synthetic oligonucleotide
ugguccacguggaaguccucuuccucg

SEQ ID NO: 277 - RNA, 27 nt, Artificial Sequence
  Synthetic oligonucleotide
cugguccacguggaaguccucuuccuc

SEQ ID NO: 278 - RNA, 27 nt, Artificial Sequence
  Synthetic oligonucleotide
ccugguccacguggaaguccucuuccu

SEQ ID NO: 279 - RNA, 27 nt, Artificial Sequence
  Synthetic oligonucleotide
accugguccacguggaaguccucuucc

SEQ ID NO: 280 - RNA, 27 nt, Artificial Sequence
  Synthetic oligonucleotide
ucaccugguccacguggaaguccucuu

SEQ ID NO: 281 - RNA, 27 nt, Artificial Sequence
  Synthetic oligonucleotide
gucaccugguccacguggaaguccucu

SEQ ID NO: 282 - RNA, 27 nt, Artificial Sequence
  Synthetic oligonucleotide
uggucaccugguccacguggaaguccu

SEQ ID NO: 283 - RNA, 27 nt, Artificial Sequence
  Synthetic oligonucleotide
ugcuggauguuaaacaugccuaaacgc

SEQ ID NO: 284 - RNA, 27 nt, Artificial Sequence
  Synthetic oligonucleotide
gugcuggauguuaaacaugccuaaacg

SEQ ID NO: 285 - RNA, 27 nt, Artificial Sequence
  Synthetic oligonucleotide
caucagcagcacccagcuggacagcuu

SEQ ID NO: 286 - RNA, 27 nt, Artificial Sequence
  Synthetic oligonucleotide
ucaucagcagcacccagcuggacagcu

SEQ ID NO: 287 - RNA, 27 nt, Artificial Sequence
  Synthetic oligonucleotide
caggaagaagauggcgguggcauugcc

SEQ ID NO: 288 - RNA, 27 nt, Artificial Sequence
  Synthetic oligonucleotide
gcaggaagaagauggcgguggcauugc

SEQ ID NO: 289 - RNA, 27 nt, Artificial Sequence
  Synthetic oligonucleotide
ucaggcaggaagaagauggcgguggca

SEQ ID NO: 290 - RNA, 27 nt, Artificial Sequence
  Synthetic oligonucleotide
aucaggcaggaagaagauggcgguggc

SEQ ID NO: 291 - RNA, 27 nt, Artificial Sequence
  Synthetic oligonucleotide
caucaggcaggaagaagauggcggugg

SEQ ID NO: 292 - RNA, 27 nt, Artificial Sequence
  Synthetic oligonucleotide
ucaucaggcaggaagaagauggcggug

SEQ ID NO: 293 - RNA, 27 nt, Artificial Sequence
  Synthetic oligonucleotide
cucaucaggcaggaagaagauggcggu

SEQ ID NO: 294 - RNA, 27 nt, Artificial Sequence
  Synthetic oligonucleotide
ccucaucaggcaggaagaagauggcgg

SEQ ID NO: 295 - RNA, 27 nt, Artificial Sequence
  Synthetic oligonucleotide
uccccucaucaggcaggaagaagaugg

SEQ ID NO: 296 - RNA, 27 nt, Artificial Sequence
  Synthetic oligonucleotide
uaguuuccccucaucaggcaggaagaa

SEQ ID NO: 297 - RNA, 27 nt, Artificial Sequence
  Synthetic oligonucleotide
guaguuuccccucaucaggcaggaaga

SEQ ID NO: 298 - RNA, 27 nt, Artificial Sequence
  Synthetic oligonucleotide
uguaguuuccccucaucaggcaggaag

SEQ ID NO: 299 - RNA, 27 nt, Artificial Sequence
  Synthetic oligonucleotide
cuguaguuuccccucaucaggcaggaa

SEQ ID NO: 300 - RNA, 27 nt, Artificial Sequence
  Synthetic oligonucleotide
gcuguaguuuccccucaucaggcagga

SEQ ID NO: 301 - RNA, 27 nt, Artificial Sequence
  Synthetic oligonucleotide
ugcuguaguuuccccucaucaggcagg

SEQ ID NO: 302 - RNA, 27 nt, Artificial Sequence
  Synthetic oligonucleotide
ugggugaguucauuuuccaggugcugu

SEQ ID NO: 303 - RNA, 27 nt, Artificial Sequence
  Synthetic oligonucleotide
gugggugaguucauuuuccaggugcug

SEQ ID NO: 304 - RNA, 27 nt, Artificial Sequence
  Synthetic oligonucleotide
cgugggugaguucauuuuccaggugcu

SEQ ID NO: 305 - RNA, 27 nt, Artificial Sequence
  Synthetic oligonucleotide
ucgugggugaguucauuuuccaggugc

SEQ ID NO: 306 - RNA, 27 nt, Artificial Sequence
  Synthetic oligonucleotide
aucgugggugaguucauuuuccaggug

SEQ ID NO: 307 - RNA, 27 nt, Artificial Sequence
  Synthetic oligonucleotide
uuuuccaggaacuuggugaugauaucg

SEQ ID NO: 308 - RNA, 27 nt, Artificial Sequence
  Synthetic oligonucleotide
auuuuccaggaacuuggugaugauauc

SEQ ID NO: 309 - RNA, 27 nt, Artificial Sequence
  Synthetic oligonucleotide
cauuuuccaggaacuuggugaugauau

SEQ ID NO: 310 - RNA, 27 nt, Artificial Sequence
  Synthetic oligonucleotide
ucauuuuccaggaacuuggugaugaua

SEQ ID NO: 311 - RNA, 27 nt, Artificial Sequence
  Synthetic oligonucleotide
uucauuuuccaggaacuuggugaugau

SEQ ID NO: 312 - RNA, 27 nt, Artificial Sequence
  Synthetic oligonucleotide
cuucauuuuccaggaacuuggugauga

SEQ ID NO: 313 - RNA, 27 nt, Artificial Sequence
  Synthetic oligonucleotide
ucuucauuuuccaggaacuuggugaug

SEQ ID NO: 314 - RNA, 27 nt, Artificial Sequence
  Synthetic oligonucleotide
gucuucauuuuccaggaacuuggugau

SEQ ID NO: 315 - RNA, 27 nt, Artificial Sequence
  Synthetic oligonucleotide
ugucuucauuuuccaggaacuugguga

SEQ ID NO: 316 - RNA, 27 nt, Artificial Sequence
  Synthetic oligonucleotide
cugucuucauuuuccaggaacuuggug

SEQ ID NO: 317 - RNA, 27 nt, Artificial Sequence
  Synthetic oligonucleotide
aggucagccccauugcugaagaccuua

SEQ ID NO: 318 - RNA, 27 nt, Artificial Sequence
  Synthetic oligonucleotide
gaccccggagaggucagccccauugcu

SEQ ID NO: 319 - RNA, 27 nt, Artificial Sequence
  Synthetic oligonucleotide
ugaccccggagaggucagccccauugc

SEQ ID NO: 320 - RNA, 27 nt, Artificial Sequence
  Synthetic oligonucleotide
gugaccccggagaggucagccccauug

SEQ ID NO: 321 - RNA, 27 nt, Artificial Sequence
  Synthetic oligonucleotide
uggagagcuucaggggugccuccucug

SEQ ID NO: 322 - RNA, 27 nt, Artificial Sequence
  Synthetic oligonucleotide
cuuggagagcuucaggggugccuccuc

SEQ ID NO: 323 - RNA, 27 nt, Artificial Sequence
  Synthetic oligonucleotide
uaugcacggccuuggagagcuucaggg

SEQ ID NO: 324 - RNA, 27 nt, Artificial Sequence
  Synthetic oligonucleotide
gauggucagcacagccuuaugcacggc

SEQ ID NO: 325 - RNA, 27 nt, Artificial Sequence
  Synthetic oligonucleotide
cgauggucagcacagccuuaugcacgg

SEQ ID NO: 326 - RNA, 27 nt, Artificial Sequence
  Synthetic oligonucleotide
ucgauggucagcacagccuuaugcacg

SEQ ID NO: 327 - RNA, 27 nt, Artificial Sequence
  Synthetic oligonucleotide
gucgauggucagcacagccuuaugcac

SEQ ID NO: 328 - RNA, 27 nt, Artificial Sequence
  Synthetic oligonucleotide
cgucgauggucagcacagccuuaugca

SEQ ID NO: 329 - RNA, 27 nt, Artificial Sequence
  Synthetic oligonucleotide
ucgucgauggucagcacagccuuaugc

SEQ ID NO: 330 - RNA, 27 nt, Artificial Sequence
  Synthetic oligonucleotide
cucgucgauggucagcacagccuuaug

SEQ ID NO: 331 - RNA, 27 nt, Artificial Sequence
  Synthetic oligonucleotide
ucucgucgauggucagcacagccuuau

SEQ ID NO: 332 - RNA, 27 nt, Artificial Sequence
  Synthetic oligonucleotide
uucucgucgauggucagcacagccuua

SEQ ID NO: 333 - RNA, 27 nt, Artificial Sequence
  Synthetic oligonucleotide
aaaacauggccccagcagcuucagucc

SEQ ID NO: 334 - RNA, 27 nt, Artificial Sequence
  Synthetic oligonucleotide
aaaaacauggccccagcagcuucaguc

SEQ ID NO: 335 - RNA, 27 nt, Artificial Sequence
  Synthetic oligonucleotide
uaaaaacauggccccagcagcuucagu

SEQ ID NO: 336 - RNA, 27 nt, Artificial Sequence
  Synthetic oligonucleotide
cuaaaaacauggccccagcagcuucag

SEQ ID NO: 337 - RNA, 27 nt, Artificial Sequence
  Synthetic oligonucleotide
ucuaaaaacauggccccagcagcuuca

SEQ ID NO: 338 - RNA, 27 nt, Artificial Sequence
  Synthetic oligonucleotide
cucuaaaaacauggccccagcagcuuc

SEQ ID NO: 339 - RNA, 27 nt, Artificial Sequence
  Synthetic oligonucleotide
uggguauggccucuaaaaacauggccc

SEQ ID NO: 340 - RNA, 27 nt, Artificial Sequence
  Synthetic oligonucleotide
auggguauggccucuaaaaacauggcc

SEQ ID NO: 341 - RNA, 27 nt, Artificial Sequence
  Synthetic oligonucleotide
cauggguauggccucuaaaaacauggc

SEQ ID NO: 342 - RNA, 27 nt, Artificial Sequence
  Synthetic oligonucleotide
acauggguauggccucuaaaaacaugg

SEQ ID NO: 343 - RNA, 27 nt, Artificial Sequence
  Synthetic oligonucleotide
gacauggguauggccucuaaaaacaug

SEQ ID NO: 344 - RNA, 27 nt, Artificial Sequence
  Synthetic oligonucleotide
agacauggguauggccucuaaaaacau

SEQ ID NO: 345 - RNA, 27 nt, Artificial Sequence
  Synthetic oligonucleotide
uagacauggguauggccucuaaaaaca

SEQ ID NO: 346 - RNA, 27 nt, Artificial Sequence
  Synthetic oligonucleotide
auagacauggguauggccucuaaaaac

SEQ ID NO: 347 - RNA, 27 nt, Artificial Sequence
  Synthetic oligonucleotide
gauagacauggguauggccucuaaaaa

SEQ ID NO: 348 - RNA, 27 nt, Artificial Sequence
  Synthetic oligonucleotide
ggauagacauggguauggccucuaaaa

SEQ ID NO: 349 - RNA, 27 nt, Artificial Sequence
  Synthetic oligonucleotide
gggauagacauggguauggccucuaaa

SEQ ID NO: 350 - RNA, 27 nt, Artificial Sequence
  Synthetic oligonucleotide
ggggauagacauggguauggccucuaa

SEQ ID NO: 351 - RNA, 27 nt, Artificial Sequence
  Synthetic oligonucleotide
uaagaagacaaaggguuuguugaacuu

SEQ ID NO: 352 - RNA, 27 nt, Artificial Sequence
  Synthetic oligonucleotide
uuaagaagacaaaggguuuguugaacu

SEQ ID NO: 353 - RNA, 27 nt, Artificial Sequence
  Synthetic oligonucleotide
auuaagaagacaaaggguuuguugaac

SEQ ID NO: 354 - RNA, 27 nt, Artificial Sequence
  Synthetic oligonucleotide
cauuaagaagacaaaggguuuguugaa

SEQ ID NO: 355 - RNA, 27 nt, Artificial Sequence
  Synthetic oligonucleotide
ucauuaagaagacaaaggguuuguuga

SEQ ID NO: 356 - RNA, 27 nt, Artificial Sequence
  Synthetic oligonucleotide
aucauuaagaagacaaaggguuuguug

SEQ ID NO: 357 - RNA, 27 nt, Artificial Sequence
  Synthetic oligonucleotide
aaucauuaagaagacaaaggguuuguu

SEQ ID NO: 358 - RNA, 27 nt, Artificial Sequence
  Synthetic oligonucleotide
caaucauuaagaagacaaaggguuugu

SEQ ID NO: 359 - RNA, 27 nt, Artificial Sequence
  Synthetic oligonucleotide
ucaaucauuaagaagacaaaggguuug

SEQ ID NO: 360 - RNA, 27 nt, Artificial Sequence
  Synthetic oligonucleotide
ccaugaagaggggagacuugguauuuu

SEQ ID NO: 361 - RNA, 27 nt, Artificial Sequence
  Synthetic oligonucleotide
cccaugaagaggggagacuugguauuu

SEQ ID NO: 362 - RNA, 27 nt, Artificial Sequence
  Synthetic oligonucleotide
ucccaugaagaggggagacuugguauu

SEQ ID NO: 363 - RNA, 27 nt, Artificial Sequence
  Synthetic oligonucleotide
uucccaugaagaggggagacuugguau

SEQ ID NO: 364 - RNA, 27 nt, Artificial Sequence
  Synthetic oligonucleotide
uuucccaugaagaggggagacuuggua

SEQ ID NO: 365 - RNA, 27 nt, Artificial Sequence
  Synthetic oligonucleotide
uuuucccaugaagaggggagacuuggu

SEQ ID NO: 366 - RNA, 27 nt, Artificial Sequence
  Synthetic oligonucleotide
cuuuucccaugaagaggggagacuugg

SEQ ID NO: 367 - RNA, 27 nt, Artificial Sequence
  Synthetic oligonucleotide
acuuuucccaugaagaggggagacuug

SEQ ID NO: 368 - RNA, 27 nt, Artificial Sequence
  Synthetic oligonucleotide
cacuuuucccaugaagaggggagacuu

SEQ ID NO: 369 - RNA, 27 nt, Artificial Sequence
  Synthetic oligonucleotide
accacuuuucccaugaagaggggagac

SEQ ID NO: 370 - RNA, 27 nt, Artificial Sequence
  Synthetic oligonucleotide
ucaccacuuuucccaugaagaggggag

SEQ ID NO: 371 - RNA, 27 nt, Artificial Sequence
  Synthetic oligonucleotide
uucaccacuuuucccaugaagagggga

SEQ ID NO: 372 - RNA, 27 nt, Artificial Sequence
  Synthetic oligonucleotide
auucaccacuuuucccaugaagagggg

SEQ ID NO: 373 - RNA, 27 nt, Artificial Sequence
  Synthetic oligonucleotide
gauucaccacuuuucccaugaagaggg

SEQ ID NO: 374 - RNA, 27 nt, Artificial Sequence
  Synthetic oligonucleotide
ggauucaccacuuuucccaugaagagg

SEQ ID NO: 375 - RNA, 27 nt, Artificial Sequence
  Synthetic oligonucleotide
gggauucaccacuuuucccaugaagag

SEQ ID NO: 376 - RNA, 27 nt, Artificial Sequence
  Synthetic oligonucleotide
ugggauucaccacuuuucccaugaaga

SEQ ID NO: 377 - RNA, 27 nt, Artificial Sequence
  Synthetic oligonucleotide
gugggauucaccacuuuucccaugaag

SEQ ID NO: 378 - RNA, 27 nt, Artificial Sequence
  Synthetic oligonucleotide
ggugggauucaccacuuuucccaugaa

SEQ ID NO: 379 - RNA, 27 nt, Artificial Sequence
  Synthetic oligonucleotide
gggugggauucaccacuuuucccauga

SEQ ID NO: 380 - RNA, 27 nt, Artificial Sequence
  Synthetic oligonucleotide
ugggugggauucaccacuuuucccaug

SEQ ID NO: 381 - RNA, 27 nt, Artificial Sequence
  Synthetic oligonucleotide
uugggugggauucaccacuuuucccau

SEQ ID NO: 382 - RNA, 27 nt, Artificial Sequence
  Synthetic oligonucleotide
uuugggugggauucaccacuuuuccca

SEQ ID NO: 383 - RNA, 27 nt, Artificial Sequence
  Synthetic oligonucleotide
uuuugggugggauucaccacuuuuccc

SEQ ID NO: 384 - RNA, 27 nt, Artificial Sequence
  Synthetic oligonucleotide
uuuuugggugggauucaccacuuuucc

SEQ ID NO: 385 - RNA, 27 nt, Artificial Sequence
  Synthetic oligonucleotide
auuuuugggugggauucaccacuuuuc

SEQ ID NO: 386 - RNA, 27 nt, Artificial Sequence
  Synthetic oligonucleotide
uauuuuugggugggauucaccacuuuu

SEQ ID NO: 387 - RNA, 27 nt, Artificial Sequence
  Synthetic oligonucleotide
cuaauuucaccauuuugaacuaucgaa

SEQ ID NO: 388 - RNA, 27 nt, Artificial Sequence
  Synthetic oligonucleotide
uagaauugcuaauuucaccauuuugaa

SEQ ID NO: 389 - RNA, 27 nt, Artificial Sequence
  Synthetic oligonucleotide
uuaucuaacuugaacaucauaccaacu

SEQ ID NO: 390 - RNA, 27 nt, Artificial Sequence
  Synthetic oligonucleotide
uguuaucuaacuugaacaucauaccaa

SEQ ID NO: 391 - RNA, 27 nt, Artificial Sequence
  Synthetic oligonucleotide
uuguuaucuaacuugaacaucauacca

SEQ ID NO: 392 - RNA, 27 nt, Artificial Sequence
  Synthetic oligonucleotide
uuuuguuaucuaacuugaacaucauac

SEQ ID NO: 393 - RNA, 27 nt, Artificial Sequence
  Synthetic oligonucleotide
acauuuuguuaucuaacuugaacauca

SEQ ID NO: 394 - RNA, 27 nt, Artificial Sequence
  Synthetic oligonucleotide
uauaaacauuuuguuaucuaacuugaa

SEQ ID NO: 395 - RNA, 27 nt, Artificial Sequence
  Synthetic oligonucleotide
guauaaacauuuuguuaucuaacuuga

SEQ ID NO: 396 - RNA, 27 nt, Artificial Sequence
  Synthetic oligonucleotide
gguauaaacauuuuguuaucuaacuug

SEQ ID NO: 397 - DNA, 27 bp, Artificial Sequence
  Synthetic oligonucleotide
tacatcccaccatgatcaggatcaccc

SEQ ID NO: 398 - DNA, 27 bp, Artificial Sequence
  Synthetic oligonucleotide
gccagctggcacaccagtccaacagca

SEQ ID NO: 399 - DNA, 27 bp, Artificial Sequence
  Synthetic oligonucleotide
cagctggcacaccagtccaacagcacc

SEQ ID NO: 400 - DNA, 27 bp, Artificial Sequence
  Synthetic oligonucleotide
ctggcacaccagtccaacagcaccaat

SEQ ID NO: 401 - DNA, 27 bp, Artificial Sequence
  Synthetic oligonucleotide
tggcacaccagtccaacagcaccaata

SEQ ID NO: 402 - DNA, 27 bp, Artificial Sequence
  Synthetic oligonucleotide
ggcacaccagtccaacagcaccaatat

SEQ ID NO: 403 - DNA, 27 bp, Artificial Sequence
  Synthetic oligonucleotide
gcacaccagtccaacagcaccaatatc

SEQ ID NO: 404 - DNA, 27 bp, Artificial Sequence
  Synthetic oligonucleotide
cacaccagtccaacagcaccaatatct

SEQ ID NO: 405 - DNA, 27 bp, Artificial Sequence
  Synthetic oligonucleotide
caccaatatcttcttctccccagtgag

SEQ ID NO: 406 - DNA, 27 bp, Artificial Sequence
  Synthetic oligonucleotide
accaatatcttcttctccccagtgagc

SEQ ID NO: 407 - DNA, 27 bp, Artificial Sequence
  Synthetic oligonucleotide
ccaatatcttcttctccccagtgagca

SEQ ID NO: 408 - DNA, 27 bp, Artificial Sequence
  Synthetic oligonucleotide
caatatcttcttctccccagtgagcat

SEQ ID NO: 409 - DNA, 27 bp, Artificial Sequence
  Synthetic oligonucleotide
aatatcttcttctccccagtgagcatc

SEQ ID NO: 410 - DNA, 27 bp, Artificial Sequence
  Synthetic oligonucleotide
atatcttcttctccccagtgagcatcg

SEQ ID NO: 411 - DNA, 27 bp, Artificial Sequence
  Synthetic oligonucleotide
tatcttcttctccccagtgagcatcgc

SEQ ID NO: 412 - DNA, 27 bp, Artificial Sequence
  Synthetic oligonucleotide
atcttcttctccccagtgagcatcgct

SEQ ID NO: 413 - DNA, 27 bp, Artificial Sequence
  Synthetic oligonucleotide
tcttcttctccccagtgagcatcgcta

SEQ ID NO: 414 - DNA, 27 bp, Artificial Sequence
  Synthetic oligonucleotide
cttcttctccccagtgagcatcgctac

SEQ ID NO: 415 - DNA, 27 bp, Artificial Sequence
  Synthetic oligonucleotide
ttcttctccccagtgagcatcgctaca

SEQ ID NO: 416 - DNA, 27 bp, Artificial Sequence
  Synthetic oligonucleotide
cttctccccagtgagcatcgctacagc

SEQ ID NO: 417 - DNA, 27 bp, Artificial Sequence
  Synthetic oligonucleotide
ttctccccagtgagcatcgctacagcc

SEQ ID NO: 418 - DNA, 27 bp, Artificial Sequence
  Synthetic oligonucleotide
ctccccagtgagcatcgctacagcctt

SEQ ID NO: 419 - DNA, 27 bp, Artificial Sequence
  Synthetic oligonucleotide
ctacagcctttgcaatgctctccctgg

SEQ ID NO: 420 - DNA, 27 bp, Artificial Sequence
  Synthetic oligonucleotide
tttgcaatgctctccctggggaccaag

SEQ ID NO: 421 - DNA, 27 bp, Artificial Sequence
  Synthetic oligonucleotide
tgaaatcctggagggcctgaatttcaa

SEQ ID NO: 422 - DNA, 27 bp, Artificial Sequence
  Synthetic oligonucleotide
gaaatcctggagggcctgaatttcaac

SEQ ID NO: 423 - DNA, 27 bp, Artificial Sequence
  Synthetic oligonucleotide
aaatcctggagggcctgaatttcaacc

SEQ ID NO: 424 - DNA, 27 bp, Artificial Sequence
  Synthetic oligonucleotide
atcctggagggcctgaatttcaacctc

SEQ ID NO: 425 - DNA, 27 bp, Artificial Sequence
  Synthetic oligonucleotide
tcctggagggcctgaatttcaacctca

SEQ ID NO: 426 - DNA, 27 bp, Artificial Sequence
  Synthetic oligonucleotide
cctggagggcctgaatttcaacctcac

SEQ ID NO: 427 - DNA, 27 bp, Artificial Sequence
  Synthetic oligonucleotide
tccatgaaggcttccaggaactcctcc

SEQ ID NO: 428 - DNA, 27 bp, Artificial Sequence
  Synthetic oligonucleotide
atgaaggcttccaggaactcctccgta

SEQ ID NO: 429 - DNA, 27 bp, Artificial Sequence
  Synthetic oligonucleotide
tgaaggcttccaggaactcctccgtac

SEQ ID NO: 430 - DNA, 27 bp, Artificial Sequence
  Synthetic oligonucleotide
ccagccagacagccagctccagctgac

SEQ ID NO: 431 - DNA, 27 bp, Artificial Sequence
  Synthetic oligonucleotide
agccagacagccagctccagctgacca

SEQ ID NO: 432 - DNA, 27 bp, Artificial Sequence
  Synthetic oligonucleotide
ccagacagccagctccagctgaccacc

SEQ ID NO: 433 - DNA, 27 bp, Artificial Sequence
  Synthetic oligonucleotide
cagacagccagctccagctgaccaccg

SEQ ID NO: 434 - DNA, 27 bp, Artificial Sequence
  Synthetic oligonucleotide
gctagtggataagtttttggaggatgt

SEQ ID NO: 435 - DNA, 27 bp, Artificial Sequence
  Synthetic oligonucleotide
ctagtggataagtttttggaggatgtt

SEQ ID NO: 436 - DNA, 27 bp, Artificial Sequence
  Synthetic oligonucleotide
tagtggataagtttttggaggatgtta

SEQ ID NO: 437 - DNA, 27 bp, Artificial Sequence
  Synthetic oligonucleotide
agtggataagtttttggaggatgttaa

SEQ ID NO: 438 - DNA, 27 bp, Artificial Sequence
  Synthetic oligonucleotide
gtggataagtttttggaggatgttaaa

SEQ ID NO: 439 - DNA, 27 bp, Artificial Sequence
  Synthetic oligonucleotide
tggataagtttttggaggatgttaaaa

SEQ ID NO: 440 - DNA, 27 bp, Artificial Sequence
  Synthetic oligonucleotide
ggataagtttttggaggatgttaaaaa

SEQ ID NO: 441 - DNA, 27 bp, Artificial Sequence
  Synthetic oligonucleotide
gttgtaccactcagaagccttcactgt

SEQ ID NO: 442 - DNA, 27 bp, Artificial Sequence
  Synthetic oligonucleotide
ttgtaccactcagaagccttcactgtc

SEQ ID NO: 443 - DNA, 27 bp, Artificial Sequence
  Synthetic oligonucleotide
gtactcaagggaaaattgtggatttgg

SEQ ID NO: 444 - DNA, 27 bp, Artificial Sequence
  Synthetic oligonucleotide
tactcaagggaaaattgtggatttggt

SEQ ID NO: 445 - DNA, 27 bp, Artificial Sequence
  Synthetic oligonucleotide
actcaagggaaaattgtggatttggtc

SEQ ID NO: 446 - DNA, 27 bp, Artificial Sequence
  Synthetic oligonucleotide
ctcaagggaaaattgtggatttggtca

SEQ ID NO: 447 - DNA, 27 bp, Artificial Sequence
  Synthetic oligonucleotide
tcaagggaaaattgtggatttggtcaa

SEQ ID NO: 448 - DNA, 27 bp, Artificial Sequence
  Synthetic oligonucleotide
caagggaaaattgtggatttggtcaag

SEQ ID NO: 449 - DNA, 27 bp, Artificial Sequence
  Synthetic oligonucleotide
aagggaaaattgtggatttggtcaagg

SEQ ID NO: 450 - DNA, 27 bp, Artificial Sequence
  Synthetic oligonucleotide
agggaaaattgtggatttggtcaagga

SEQ ID NO: 451 - DNA, 27 bp, Artificial Sequence
  Synthetic oligonucleotide
gggaaaattgtggatttggtcaaggag

SEQ ID NO: 452 - DNA, 27 bp, Artificial Sequence
  Synthetic oligonucleotide
ggaaaattgtggatttggtcaaggagc

SEQ ID NO: 453 - DNA, 27 bp, Artificial Sequence
  Synthetic oligonucleotide
gaaaattgtggatttggtcaaggagct

SEQ ID NO: 454 - DNA, 27 bp, Artificial Sequence
  Synthetic oligonucleotide
aaaattgtggatttggtcaaggagctt

SEQ ID NO: 455 - DNA, 27 bp, Artificial Sequence
  Synthetic oligonucleotide
aaattgtggatttggtcaaggagcttg

SEQ ID NO: 456 - DNA, 27 bp, Artificial Sequence
  Synthetic oligonucleotide
aattgtggatttggtcaaggagcttga

SEQ ID NO: 457 - DNA, 27 bp, Artificial Sequence
  Synthetic oligonucleotide
attgtggatttggtcaaggagcttgac

SEQ ID NO: 458 - DNA, 27 bp, Artificial Sequence
  Synthetic oligonucleotide
ttgtggatttggtcaaggagcttgaca

SEQ ID NO: 459 - DNA, 27 bp, Artificial Sequence
  Synthetic oligonucleotide
tgtggatttggtcaaggagcttgacag

SEQ ID NO: 460 - DNA, 27 bp, Artificial Sequence
  Synthetic oligonucleotide
gtggatttggtcaaggagcttgacaga

SEQ ID NO: 461 - DNA, 27 bp, Artificial Sequence
  Synthetic oligonucleotide
tggatttggtcaaggagcttgacagag

SEQ ID NO: 462 - DNA, 27 bp, Artificial Sequence
  Synthetic oligonucleotide
ggatttggtcaaggagcttgacagaga

SEQ ID NO: 463 - DNA, 27 bp, Artificial Sequence
  Synthetic oligonucleotide
gatttggtcaaggagcttgacagagac

SEQ ID NO: 464 - DNA, 27 bp, Artificial Sequence
  Synthetic oligonucleotide
atttggtcaaggagcttgacagagaca

SEQ ID NO: 465 - DNA, 27 bp, Artificial Sequence
  Synthetic oligonucleotide
tttggtcaaggagcttgacagagacac

SEQ ID NO: 466 - DNA, 27 bp, Artificial Sequence
  Synthetic oligonucleotide
cacagtttttgctctggtgaattacat

SEQ ID NO: 467 - DNA, 27 bp, Artificial Sequence
  Synthetic oligonucleotide
acagtttttgctctggtgaattacatc

SEQ ID NO: 468 - DNA, 27 bp, Artificial Sequence
  Synthetic oligonucleotide
cagtttttgctctggtgaattacatct

SEQ ID NO: 469 - DNA, 27 bp, Artificial Sequence
  Synthetic oligonucleotide
agtttttgctctggtgaattacatctt

SEQ ID NO: 470 - DNA, 27 bp, Artificial Sequence
  Synthetic oligonucleotide
ttaaaggcaaatgggagagaccctttg

SEQ ID NO: 471 - DNA, 27 bp, Artificial Sequence
  Synthetic oligonucleotide
taaaggcaaatgggagagaccctttga

SEQ ID NO: 472 - DNA, 27 bp, Artificial Sequence
  Synthetic oligonucleotide
aaaggcaaatgggagagaccctttgaa

SEQ ID NO: 473 - DNA, 27 bp, Artificial Sequence
  Synthetic oligonucleotide
aaggcaaatgggagagaccctttgaag

SEQ ID NO: 474 - DNA, 27 bp, Artificial Sequence
  Synthetic oligonucleotide
cgaggaagaggacttccacgtggacca

SEQ ID NO: 475 - DNA, 27 bp, Artificial Sequence
  Synthetic oligonucleotide
gaggaagaggacttccacgtggaccag

SEQ ID NO: 476 - DNA, 27 bp, Artificial Sequence
  Synthetic oligonucleotide
aggaagaggacttccacgtggaccagg

SEQ ID NO: 477 - DNA, 27 bp, Artificial Sequence
  Synthetic oligonucleotide
ggaagaggacttccacgtggaccaggt

SEQ ID NO: 478 - DNA, 27 bp, Artificial Sequence
  Synthetic oligonucleotide
aagaggacttccacgtggaccaggtga

SEQ ID NO: 479 - DNA, 27 bp, Artificial Sequence
  Synthetic oligonucleotide
agaggacttccacgtggaccaggtgac

SEQ ID NO: 480 - DNA, 27 bp, Artificial Sequence
  Synthetic oligonucleotide
aggacttccacgtggaccaggtgacca

SEQ ID NO: 481 - DNA, 27 bp, Artificial Sequence
  Synthetic oligonucleotide
gcgtttaggcatgtttaacatccagca

SEQ ID NO: 482 - DNA, 27 bp, Artificial Sequence
  Synthetic oligonucleotide
cgtttaggcatgtttaacatccagcac

SEQ ID NO: 483 - DNA, 27 bp, Artificial Sequence
  Synthetic oligonucleotide
aagctgtccagctgggtgctgctgatg

SEQ ID NO: 484 - DNA, 27 bp, Artificial Sequence
  Synthetic oligonucleotide
agctgtccagctgggtgctgctgatga

SEQ ID NO: 485 - DNA, 27 bp, Artificial Sequence
  Synthetic oligonucleotide
ggcaatgccaccgccatcttcttcctg

SEQ ID NO: 486 - DNA, 27 bp, Artificial Sequence
  Synthetic oligonucleotide
gcaatgccaccgccatcttcttcctgc

SEQ ID NO: 487 - DNA, 27 bp, Artificial Sequence
  Synthetic oligonucleotide
tgccaccgccatcttcttcctgcctga

SEQ ID NO: 488 - DNA, 27 bp, Artificial Sequence
  Synthetic oligonucleotide
gccaccgccatcttcttcctgcctgat

SEQ ID NO: 489 - DNA, 27 bp, Artificial Sequence
  Synthetic oligonucleotide
ccaccgccatcttcttcctgcctgatg

SEQ ID NO: 490 - DNA, 27 bp, Artificial Sequence
  Synthetic oligonucleotide
caccgccatcttcttcctgcctgatga

SEQ ID NO: 491 - DNA, 27 bp, Artificial Sequence
  Synthetic oligonucleotide
accgccatcttcttcctgcctgatgag

SEQ ID NO: 492 - DNA, 27 bp, Artificial Sequence
  Synthetic oligonucleotide
ccgccatcttcttcctgcctgatgagg

SEQ ID NO: 493 - DNA, 27 bp, Artificial Sequence
  Synthetic oligonucleotide
ccatcttcttcctgcctgatgagggga

SEQ ID NO: 494 - DNA, 27 bp, Artificial Sequence
  Synthetic oligonucleotide
ttcttcctgcctgatgaggggaaacta

SEQ ID NO: 495 - DNA, 27 bp, Artificial Sequence
  Synthetic oligonucleotide
tcttcctgcctgatgaggggaaactac

SEQ ID NO: 496 - DNA, 27 bp, Artificial Sequence
  Synthetic oligonucleotide
cttcctgcctgatgaggggaaactaca

SEQ ID NO: 497 - DNA, 27 bp, Artificial Sequence
  Synthetic oligonucleotide
ttcctgcctgatgaggggaaactacag

SEQ ID NO: 498 - DNA, 27 bp, Artificial Sequence
  Synthetic oligonucleotide
tcctgcctgatgaggggaaactacagc

SEQ ID NO: 499 - DNA, 27 bp, Artificial Sequence
  Synthetic oligonucleotide
cctgcctgatgaggggaaactacagca

SEQ ID NO: 500 - DNA, 27 bp, Artificial Sequence
  Synthetic oligonucleotide
acagcacctggaaaatgaactcaccca

SEQ ID NO: 501 - DNA, 27 bp, Artificial Sequence
  Synthetic oligonucleotide
cagcacctggaaaatgaactcacccac

SEQ ID NO: 502 - DNA, 27 bp, Artificial Sequence
  Synthetic oligonucleotide
agcacctggaaaatgaactcacccacg

SEQ ID NO: 503 - DNA, 27 bp, Artificial Sequence
  Synthetic oligonucleotide
gcacctggaaaatgaactcacccacga

SEQ ID NO: 504 - DNA, 27 bp, Artificial Sequence
  Synthetic oligonucleotide
cacctggaaaatgaactcacccacgat

SEQ ID NO: 505 - DNA, 27 bp, Artificial Sequence
  Synthetic oligonucleotide
cgatatcatcaccaagttcctggaaaa

SEQ ID NO: 506 - DNA, 27 bp, Artificial Sequence
  Synthetic oligonucleotide
gatatcatcaccaagttcctggaaaat

SEQ ID NO: 507 - DNA, 27 bp, Artificial Sequence
  Synthetic oligonucleotide
atatcatcaccaagttcctggaaaatg

SEQ ID NO: 508 - DNA, 27 bp, Artificial Sequence
  Synthetic oligonucleotide
tatcatcaccaagttcctggaaaatga

SEQ ID NO: 509 - DNA, 27 bp, Artificial Sequence
  Synthetic oligonucleotide
atcatcaccaagttcctggaaaatgaa

SEQ ID NO: 510 - DNA, 27 bp, Artificial Sequence
  Synthetic oligonucleotide
tcatcaccaagttcctggaaaatgaag

SEQ ID NO: 511 - DNA, 27 bp, Artificial Sequence
  Synthetic oligonucleotide
catcaccaagttcctggaaaatgaaga

SEQ ID NO: 512 - DNA, 27 bp, Artificial Sequence
  Synthetic oligonucleotide
atcaccaagttcctggaaaatgaagac

SEQ ID NO: 513 - DNA, 27 bp, Artificial Sequence
  Synthetic oligonucleotide
tcaccaagttcctggaaaatgaagaca

SEQ ID NO: 514 - DNA, 27 bp, Artificial Sequence
  Synthetic oligonucleotide
caccaagttcctggaaaatgaagacag

SEQ ID NO: 515 - DNA, 27 bp, Artificial Sequence
  Synthetic oligonucleotide
taaggtcttcagcaatggggctgacct

SEQ ID NO: 516 - DNA, 27 bp, Artificial Sequence
  Synthetic oligonucleotide
agcaatggggctgacctctccggggtc

SEQ ID NO: 517 - DNA, 27 bp, Artificial Sequence
  Synthetic oligonucleotide
gcaatggggctgacctctccggggtca

SEQ ID NO: 518 - DNA, 27 bp, Artificial Sequence
  Synthetic oligonucleotide
caatggggctgacctctccggggtcac

SEQ ID NO: 519 - DNA, 27 bp, Artificial Sequence
  Synthetic oligonucleotide
cagaggaggcacccctgaagctctcca

SEQ ID NO: 520 - DNA, 27 bp, Artificial Sequence
  Synthetic oligonucleotide
gaggaggcacccctgaagctctccaag

SEQ ID NO: 521 - DNA, 27 bp, Artificial Sequence
  Synthetic oligonucleotide
ccctgaagctctccaaggccgtgcata

SEQ ID NO: 522 - DNA, 27 bp, Artificial Sequence
  Synthetic oligonucleotide
gccgtgcataaggctgtgctgaccatc

SEQ ID NO: 523 - DNA, 27 bp, Artificial Sequence
  Synthetic oligonucleotide
ccgtgcataaggctgtgctgaccatcg

SEQ ID NO: 524 - DNA, 27 bp, Artificial Sequence
  Synthetic oligonucleotide
cgtgcataaggctgtgctgaccatcga

SEQ ID NO: 525 - DNA, 27 bp, Artificial Sequence
  Synthetic oligonucleotide
gtgcataaggctgtgctgaccatcgac

SEQ ID NO: 526 - DNA, 27 bp, Artificial Sequence
  Synthetic oligonucleotide
tgcataaggctgtgctgaccatcgacg

SEQ ID NO: 527 - DNA, 27 bp, Artificial Sequence
  Synthetic oligonucleotide
gcataaggctgtgctgaccatcgacga

SEQ ID NO: 528 - DNA, 27 bp, Artificial Sequence
  Synthetic oligonucleotide
cataaggctgtgctgaccatcgacgag

SEQ ID NO: 529 - DNA, 27 bp, Artificial Sequence
  Synthetic oligonucleotide
ataaggctgtgctgaccatcgacgaga

SEQ ID NO: 530 - DNA, 27 bp, Artificial Sequence
  Synthetic oligonucleotide
taaggctgtgctgaccatcgacgagaa

SEQ ID NO: 531 - DNA, 27 bp, Artificial Sequence
  Synthetic oligonucleotide
ggactgaagctgctggggccatgtttt

SEQ ID NO: 532 - DNA, 27 bp, Artificial Sequence
  Synthetic oligonucleotide
gactgaagctgctggggccatgttttt

SEQ ID NO: 533 - DNA, 27 bp, Artificial Sequence
  Synthetic oligonucleotide
actgaagctgctggggccatgttttta

SEQ ID NO: 534 - DNA, 27 bp, Artificial Sequence
  Synthetic oligonucleotide
ctgaagctgctggggccatgtttttag

SEQ ID NO: 535 - DNA, 27 bp, Artificial Sequence
  Synthetic oligonucleotide
tgaagctgctggggccatgtttttaga

SEQ ID NO: 536 - DNA, 27 bp, Artificial Sequence
  Synthetic oligonucleotide
gaagctgctggggccatgtttttagag

SEQ ID NO: 537 - DNA, 27 bp, Artificial Sequence
  Synthetic oligonucleotide
gggccatgtttttagaggccataccca

SEQ ID NO: 538 - DNA, 27 bp, Artificial Sequence
  Synthetic oligonucleotide
ggccatgtttttagaggccatacccat

SEQ ID NO: 539 - DNA, 27 bp, Artificial Sequence
  Synthetic oligonucleotide
gccatgtttttagaggccatacccatg

SEQ ID NO: 540 - DNA, 27 bp, Artificial Sequence
  Synthetic oligonucleotide
ccatgtttttagaggccatacccatgt

SEQ ID NO: 541 - DNA, 27 bp, Artificial Sequence
  Synthetic oligonucleotide
catgtttttagaggccatacccatgtc

SEQ ID NO: 542 - DNA, 27 bp, Artificial Sequence
  Synthetic oligonucleotide
atgtttttagaggccatacccatgtct

SEQ ID NO: 543 - DNA, 27 bp, Artificial Sequence
  Synthetic oligonucleotide
tgtttttagaggccatacccatgtcta

SEQ ID NO: 544 - DNA, 27 bp, Artificial Sequence
  Synthetic oligonucleotide
gtttttagaggccatacccatgtctat

SEQ ID NO: 545 - DNA, 27 bp, Artificial Sequence
  Synthetic oligonucleotide
tttttagaggccatacccatgtctatc

SEQ ID NO: 546 - DNA, 27 bp, Artificial Sequence
  Synthetic oligonucleotide
ttttagaggccatacccatgtctatcc

SEQ ID NO: 547 - DNA, 27 bp, Artificial Sequence
  Synthetic oligonucleotide
tttagaggccatacccatgtctatccc

SEQ ID NO: 548 - DNA, 27 bp, Artificial Sequence
  Synthetic oligonucleotide
ttagaggccatacccatgtctatcccc

SEQ ID NO: 549 - DNA, 27 bp, Artificial Sequence
  Synthetic oligonucleotide
aagttcaacaaaccctttgtcttctta

SEQ ID NO: 550 - DNA, 27 bp, Artificial Sequence
  Synthetic oligonucleotide
agttcaacaaaccctttgtcttcttaa

SEQ ID NO: 551 - DNA, 27 bp, Artificial Sequence
  Synthetic oligonucleotide
gttcaacaaaccctttgtcttcttaat

SEQ ID NO: 552 - DNA, 27 bp, Artificial Sequence
  Synthetic oligonucleotide
ttcaacaaaccctttgtcttcttaatg

SEQ ID NO: 553 - DNA, 27 bp, Artificial Sequence
  Synthetic oligonucleotide
tcaacaaaccctttgtcttcttaatga

SEQ ID NO: 554 - DNA, 27 bp, Artificial Sequence
  Synthetic oligonucleotide
caacaaaccctttgtcttcttaatgat

SEQ ID NO: 555 - DNA, 27 bp, Artificial Sequence
  Synthetic oligonucleotide
aacaaaccctttgtcttcttaatgatt

SEQ ID NO: 556 - DNA, 27 bp, Artificial Sequence
  Synthetic oligonucleotide
acaaaccctttgtcttcttaatgattg

SEQ ID NO: 557 - DNA, 27 bp, Artificial Sequence
  Synthetic oligonucleotide
caaaccctttgtcttcttaatgattga

SEQ ID NO: 558 - DNA, 27 bp, Artificial Sequence
  Synthetic oligonucleotide
aaaataccaagtctcccctcttcatgg

SEQ ID NO: 559 - DNA, 27 bp, Artificial Sequence
  Synthetic oligonucleotide
aaataccaagtctcccctcttcatggg

SEQ ID NO: 560 - DNA, 27 bp, Artificial Sequence
  Synthetic oligonucleotide
aataccaagtctcccctcttcatggga

SEQ ID NO: 561 - DNA, 27 bp, Artificial Sequence
  Synthetic oligonucleotide
ataccaagtctcccctcttcatgggaa

SEQ ID NO: 562 - DNA, 27 bp, Artificial Sequence
  Synthetic oligonucleotide
taccaagtctcccctcttcatgggaaa

SEQ ID NO: 563 - DNA, 27 bp, Artificial Sequence
  Synthetic oligonucleotide
accaagtctcccctcttcatgggaaaa

SEQ ID NO: 564 - DNA, 27 bp, Artificial Sequence
  Synthetic oligonucleotide
ccaagtctcccctcttcatgggaaaag

SEQ ID NO: 565 - DNA, 27 bp, Artificial Sequence
  Synthetic oligonucleotide
caagtctcccctcttcatgggaaaagt

SEQ ID NO: 566 - DNA, 27 bp, Artificial Sequence
  Synthetic oligonucleotide
aagtctcccctcttcatgggaaaagtg

SEQ ID NO: 567 - DNA, 27 bp, Artificial Sequence
  Synthetic oligonucleotide
gtctcccctcttcatgggaaaagtggt

SEQ ID NO: 568 - DNA, 27 bp, Artificial Sequence
  Synthetic oligonucleotide
ctcccctcttcatgggaaaagtggtga

SEQ ID NO: 569 - DNA, 27 bp, Artificial Sequence
  Synthetic oligonucleotide
tcccctcttcatgggaaaagtggtgaa

SEQ ID NO: 570 - DNA, 27 bp, Artificial Sequence
  Synthetic oligonucleotide
cccctcttcatgggaaaagtggtgaat

SEQ ID NO: 571 - DNA, 27 bp, Artificial Sequence
  Synthetic oligonucleotide
ccctcttcatgggaaaagtggtgaatc

SEQ ID NO: 572 - DNA, 27 bp, Artificial Sequence
  Synthetic oligonucleotide
cctcttcatgggaaaagtggtgaatcc

SEQ ID NO: 573 - DNA, 27 bp, Artificial Sequence
  Synthetic oligonucleotide
ctcttcatgggaaaagtggtgaatccc

SEQ ID NO: 574 - DNA, 27 bp, Artificial Sequence
  Synthetic oligonucleotide
tcttcatgggaaaagtggtgaatccca

SEQ ID NO: 575 - DNA, 27 bp, Artificial Sequence
  Synthetic oligonucleotide
cttcatgggaaaagtggtgaatcccac

SEQ ID NO: 576 - DNA, 27 bp, Artificial Sequence
  Synthetic oligonucleotide
ttcatgggaaaagtggtgaatcccacc

SEQ ID NO: 577 - DNA, 27 bp, Artificial Sequence
  Synthetic oligonucleotide
tcatgggaaaagtggtgaatcccaccc

SEQ ID NO: 578 - DNA, 27 bp, Artificial Sequence
  Synthetic oligonucleotide
catgggaaaagtggtgaatcccaccca

SEQ ID NO: 579 - DNA, 27 bp, Artificial Sequence
  Synthetic oligonucleotide
atgggaaaagtggtgaatcccacccaa

SEQ ID NO: 580 - DNA, 27 bp, Artificial Sequence
  Synthetic oligonucleotide
tgggaaaagtggtgaatcccacccaaa

SEQ ID NO: 581 - DNA, 27 bp, Artificial Sequence
  Synthetic oligonucleotide
gggaaaagtggtgaatcccacccaaaa

SEQ ID NO: 582 - DNA, 27 bp, Artificial Sequence
  Synthetic oligonucleotide
ggaaaagtggtgaatcccacccaaaaa

SEQ ID NO: 583 - DNA, 27 bp, Artificial Sequence
  Synthetic oligonucleotide
gaaaagtggtgaatcccacccaaaaat

SEQ ID NO: 584 - DNA, 27 bp, Artificial Sequence
  Synthetic oligonucleotide
aaaagtggtgaatcccacccaaaaata

SEQ ID NO: 585 - DNA, 27 bp, Artificial Sequence
  Synthetic oligonucleotide
ttcgatagttcaaaatggtgaaattag

SEQ ID NO: 586 - DNA, 27 bp, Artificial Sequence
  Synthetic oligonucleotide
ttcaaaatggtgaaattagcaattcta

SEQ ID NO: 587 - DNA, 27 bp, Artificial Sequence
  Synthetic oligonucleotide
agttggtatgatgttcaagttagataa

SEQ ID NO: 588 - DNA, 27 bp, Artificial Sequence
  Synthetic oligonucleotide
ttggtatgatgttcaagttagataaca

SEQ ID NO: 589 - DNA, 27 bp, Artificial Sequence
  Synthetic oligonucleotide
tggtatgatgttcaagttagataacaa

SEQ ID NO: 590 - DNA, 27 bp, Artificial Sequence
  Synthetic oligonucleotide
gtatgatgttcaagttagataacaaaa

SEQ ID NO: 591 - DNA, 27 bp, Artificial Sequence
  Synthetic oligonucleotide
tgatgttcaagttagataacaaaatgt

SEQ ID NO: 592 - DNA, 27 bp, Artificial Sequence
  Synthetic oligonucleotide
ttcaagttagataacaaaatgtttata

SEQ ID NO: 593 - DNA, 27 bp, Artificial Sequence
  Synthetic oligonucleotide
tcaagttagataacaaaatgtttatac

SEQ ID NO: 594 - DNA, 27 bp, Artificial Sequence
  Synthetic oligonucleotide
caagttagataacaaaatgtttatacc

SEQ ID NO: 595 - RNA, 25 nt, Artificial Sequence
  Synthetic oligonucleotide
caucccaccaugaucaggaucaccc

SEQ ID NO: 596 - RNA, 25 nt, Artificial Sequence
  Synthetic oligonucleotide
cagcuggcacaccaguccaacagca

SEQ ID NO: 597 - RNA, 25 nt, Artificial Sequence
  Synthetic oligonucleotide
gcuggcacaccaguccaacagcacc

SEQ ID NO: 598 - RNA, 25 nt, Artificial Sequence
  Synthetic oligonucleotide
ggcacaccaguccaacagcaccaau

SEQ ID NO: 599 - RNA, 25 nt, Artificial Sequence
  Synthetic oligonucleotide
gcacaccaguccaacagcaccaaua

SEQ ID NO: 600 - RNA, 25 nt, Artificial Sequence
  Synthetic oligonucleotide
cacaccaguccaacagcaccaauau

SEQ ID NO: 601 - RNA, 25 nt, Artificial Sequence
  Synthetic oligonucleotide
acaccaguccaacagcaccaauauc

SEQ ID NO: 602 - RNA, 25 nt, Artificial Sequence
  Synthetic oligonucleotide
caccaguccaacagcaccaauaucu

SEQ ID NO: 603 - RNA, 25 nt, Artificial Sequence
  Synthetic oligonucleotide
ccaauaucuucuucuccccagugag

SEQ ID NO: 604 - RNA, 25 nt, Artificial Sequence
  Synthetic oligonucleotide
caauaucuucuucuccccagugagc

SEQ ID NO: 605 - RNA, 25 nt, Artificial Sequence
  Synthetic oligonucleotide
aauaucuucuucuccccagugagca

SEQ ID NO: 606 - RNA, 25 nt, Artificial Sequence
  Synthetic oligonucleotide
auaucuucuucuccccagugagcau

SEQ ID NO: 607 - RNA, 25 nt, Artificial Sequence
  Synthetic oligonucleotide
uaucuucuucuccccagugagcauc

SEQ ID NO: 608 - RNA, 25 nt, Artificial Sequence
  Synthetic oligonucleotide
aucuucuucuccccagugagcaucg

SEQ ID NO: 609 - RNA, 25 nt, Artificial Sequence
  Synthetic oligonucleotide
ucuucuucuccccagugagcaucgc

SEQ ID NO: 610 - RNA, 25 nt, Artificial Sequence
  Synthetic oligonucleotide
cuucuucuccccagugagcaucgcu

SEQ ID NO: 611 - RNA, 25 nt, Artificial Sequence
  Synthetic oligonucleotide
uucuucuccccagugagcaucgcua

SEQ ID NO: 612 - RNA, 25 nt, Artificial Sequence
  Synthetic oligonucleotide
ucuucuccccagugagcaucgcuac

SEQ ID NO: 613 - RNA, 25 nt, Artificial Sequence
  Synthetic oligonucleotide
cuucuccccagugagcaucgcuaca

SEQ ID NO: 614 - RNA, 25 nt, Artificial Sequence
  Synthetic oligonucleotide
ucuccccagugagcaucgcuacagc

SEQ ID NO: 615 - RNA, 25 nt, Artificial Sequence
  Synthetic oligonucleotide
cuccccagugagcaucgcuacagcc

SEQ ID NO: 616 - RNA, 25 nt, Artificial Sequence
  Synthetic oligonucleotide
ccccagugagcaucgcuacagccuu

SEQ ID NO: 617 - RNA, 25 nt, Artificial Sequence
  Synthetic oligonucleotide
acagccuuugcaaugcucucccugg

SEQ ID NO: 618 - RNA, 25 nt, Artificial Sequence
  Synthetic oligonucleotide
ugcaaugcucucccuggggaccaag

SEQ ID NO: 619 - RNA, 25 nt, Artificial Sequence
  Synthetic oligonucleotide
aaauccuggagggccugaauuucaa

SEQ ID NO: 620 - RNA, 25 nt, Artificial Sequence
  Synthetic oligonucleotide
aauccuggagggccugaauuucaac

SEQ ID NO: 621 - RNA, 25 nt, Artificial Sequence
  Synthetic oligonucleotide
auccuggagggccugaauuucaacc

SEQ ID NO: 622 - RNA, 25 nt, Artificial Sequence
  Synthetic oligonucleotide
ccuggagggccugaauuucaaccuc

SEQ ID NO: 623 - RNA, 25 nt, Artificial Sequence
  Synthetic oligonucleotide
cuggagggccugaauuucaaccuca

SEQ ID NO: 624 - RNA, 25 nt, Artificial Sequence
  Synthetic oligonucleotide
uggagggccugaauuucaaccucac

SEQ ID NO: 625 - RNA, 25 nt, Artificial Sequence
  Synthetic oligonucleotide
caugaaggcuuccaggaacuccucc

SEQ ID NO: 626 - RNA, 25 nt, Artificial Sequence
  Synthetic oligonucleotide
gaaggcuuccaggaacuccuccgua

SEQ ID NO: 627 - RNA, 25 nt, Artificial Sequence
  Synthetic oligonucleotide
aaggcuuccaggaacuccuccguac

SEQ ID NO: 628 - RNA, 25 nt, Artificial Sequence
  Synthetic oligonucleotide
agccagacagccagcuccagcugac

SEQ ID NO: 629 - RNA, 25 nt, Artificial Sequence
  Synthetic oligonucleotide
ccagacagccagcuccagcugacca

SEQ ID NO: 630 - RNA, 25 nt, Artificial Sequence
  Synthetic oligonucleotide
agacagccagcuccagcugaccacc

SEQ ID NO: 631 - RNA, 25 nt, Artificial Sequence
  Synthetic oligonucleotide
gacagccagcuccagcugaccaccg

SEQ ID NO: 632 - RNA, 25 nt, Artificial Sequence
  Synthetic oligonucleotide
uaguggauaaguuuuuggaggaugu

SEQ ID NO: 633 - RNA, 25 nt, Artificial Sequence
  Synthetic oligonucleotide
aguggauaaguuuuuggaggauguu

SEQ ID NO: 634 - RNA, 25 nt, Artificial Sequence
  Synthetic oligonucleotide
guggauaaguuuuuggaggauguua

SEQ ID NO: 635 - RNA, 25 nt, Artificial Sequence
  Synthetic oligonucleotide
uggauaaguuuuuggaggauguuaa

SEQ ID NO: 636 - RNA, 25 nt, Artificial Sequence
  Synthetic oligonucleotide
ggauaaguuuuuggaggauguuaaa

SEQ ID NO: 637 - RNA, 25 nt, Artificial Sequence
  Synthetic oligonucleotide
gauaaguuuuuggaggauguuaaaa

SEQ ID NO: 638 - RNA, 25 nt, Artificial Sequence
  Synthetic oligonucleotide
auaaguuuuuggaggauguuaaaaa

SEQ ID NO: 639 - RNA, 25 nt, Artificial Sequence
  Synthetic oligonucleotide
uguaccacucagaagccuucacugu

SEQ ID NO: 640 - RNA, 25 nt, Artificial Sequence
  Synthetic oligonucleotide
guaccacucagaagccuucacuguc

SEQ ID NO: 641 - RNA, 25 nt, Artificial Sequence
  Synthetic oligonucleotide
acucaagggaaaauuguggauuugg

SEQ ID NO: 642 - RNA, 25 nt, Artificial Sequence
  Synthetic oligonucleotide
cucaagggaaaauuguggauuuggu

SEQ ID NO: 643 - RNA, 25 nt, Artificial Sequence
  Synthetic oligonucleotide
ucaagggaaaauuguggauuugguc

SEQ ID NO: 644 - RNA, 25 nt, Artificial Sequence
  Synthetic oligonucleotide
caagggaaaauuguggauuugguca

SEQ ID NO: 645 - RNA, 25 nt, Artificial Sequence
  Synthetic oligonucleotide
aagggaaaauuguggauuuggucaa

SEQ ID NO: 646 - RNA, 25 nt, Artificial Sequence
  Synthetic oligonucleotide
agggaaaauuguggauuuggucaag

SEQ ID NO: 647 - RNA, 25 nt, Artificial Sequence
  Synthetic oligonucleotide
gggaaaauuguggauuuggucaagg

SEQ ID NO: 648 - RNA, 25 nt, Artificial Sequence
  Synthetic oligonucleotide
ggaaaauuguggauuuggucaagga

SEQ ID NO: 649 - RNA, 25 nt, Artificial Sequence
  Synthetic oligonucleotide
gaaaauuguggauuuggucaaggag

SEQ ID NO: 650 - RNA, 25 nt, Artificial Sequence
  Synthetic oligonucleotide
aaaauuguggauuuggucaaggagc

SEQ ID NO: 651 - RNA, 25 nt, Artificial Sequence
  Synthetic oligonucleotide
aaauuguggauuuggucaaggagcu

SEQ ID NO: 652 - RNA, 25 nt, Artificial Sequence
  Synthetic oligonucleotide
aauuguggauuuggucaaggagcuu

SEQ ID NO: 653 - RNA, 25 nt, Artificial Sequence
  Synthetic oligonucleotide
auuguggauuuggucaaggagcuug

SEQ ID NO: 654 - RNA, 25 nt, Artificial Sequence
  Synthetic oligonucleotide
uuguggauuuggucaaggagcuuga

SEQ ID NO: 655 - RNA, 25 nt, Artificial Sequence
  Synthetic oligonucleotide
uguggauuuggucaaggagcuugac

SEQ ID NO: 656 - RNA, 25 nt, Artificial Sequence
  Synthetic oligonucleotide
guggauuuggucaaggagcuugaca

SEQ ID NO: 657 - RNA, 25 nt, Artificial Sequence
  Synthetic oligonucleotide
uggauuuggucaaggagcuugacag

SEQ ID NO: 658 - RNA, 25 nt, Artificial Sequence
  Synthetic oligonucleotide
ggauuuggucaaggagcuugacaga

SEQ ID NO: 659 - RNA, 25 nt, Artificial Sequence
  Synthetic oligonucleotide
gauuuggucaaggagcuugacagag

SEQ ID NO: 660 - RNA, 25 nt, Artificial Sequence
  Synthetic oligonucleotide
auuuggucaaggagcuugacagaga

SEQ ID NO: 661 - RNA, 25 nt, Artificial Sequence
  Synthetic oligonucleotide
uuuggucaaggagcuugacagagac

SEQ ID NO: 662 - RNA, 25 nt, Artificial Sequence
  Synthetic oligonucleotide
uuggucaaggagcuugacagagaca

SEQ ID NO: 663 - RNA, 25 nt, Artificial Sequence
  Synthetic oligonucleotide
uggucaaggagcuugacagagacac

SEQ ID NO: 664 - RNA, 25 nt, Artificial Sequence
  Synthetic oligonucleotide
caguuuuugcucuggugaauuacau

SEQ ID NO: 665 - RNA, 25 nt, Artificial Sequence
  Synthetic oligonucleotide
aguuuuugcucuggugaauuacauc

SEQ ID NO: 666 - RNA, 25 nt, Artificial Sequence
  Synthetic oligonucleotide
guuuuugcucuggugaauuacaucu

SEQ ID NO: 667 - RNA, 25 nt, Artificial Sequence
  Synthetic oligonucleotide
uuuuugcucuggugaauuacaucuu

SEQ ID NO: 668 - RNA, 25 nt, Artificial Sequence
  Synthetic oligonucleotide
aaaggcaaaugggagagacccuuug

SEQ ID NO: 669 - RNA, 25 nt, Artificial Sequence
  Synthetic oligonucleotide
aaggcaaaugggagagacccuuuga

SEQ ID NO: 670 - RNA, 25 nt, Artificial Sequence
  Synthetic oligonucleotide
aggcaaaugggagagacccuuugaa

SEQ ID NO: 671 - RNA, 25 nt, Artificial Sequence
  Synthetic oligonucleotide
ggcaaaugggagagacccuuugaag

SEQ ID NO: 672 - RNA, 25 nt, Artificial Sequence
  Synthetic oligonucleotide
aggaagaggacuuccacguggacca

SEQ ID NO: 673 - RNA, 25 nt, Artificial Sequence
  Synthetic oligonucleotide
ggaagaggacuuccacguggaccag

SEQ ID NO: 674 - RNA, 25 nt, Artificial Sequence
  Synthetic oligonucleotide
gaagaggacuuccacguggaccagg

SEQ ID NO: 675 - RNA, 25 nt, Artificial Sequence
  Synthetic oligonucleotide
aagaggacuuccacguggaccaggu

SEQ ID NO: 676 - RNA, 25 nt, Artificial Sequence
  Synthetic oligonucleotide
gaggacuuccacguggaccagguga

SEQ ID NO: 677 - RNA, 25 nt, Artificial Sequence
  Synthetic oligonucleotide
aggacuuccacguggaccaggugac

SEQ ID NO: 678 - RNA, 25 nt, Artificial Sequence
  Synthetic oligonucleotide
gacuuccacguggaccaggugacca

SEQ ID NO: 679 - RNA, 25 nt, Artificial Sequence
  Synthetic oligonucleotide
guuuaggcauguuuaacauccagca

SEQ ID NO: 680 - RNA, 25 nt, Artificial Sequence
  Synthetic oligonucleotide
uuuaggcauguuuaacauccagcac

SEQ ID NO: 681 - RNA, 25 nt, Artificial Sequence
  Synthetic oligonucleotide
gcuguccagcugggugcugcugaug

SEQ ID NO: 682 - RNA, 25 nt, Artificial Sequence
  Synthetic oligonucleotide
cuguccagcugggugcugcugauga

SEQ ID NO: 683 - RNA, 25 nt, Artificial Sequence
  Synthetic oligonucleotide
caaugccaccgccaucuucuuccug

SEQ ID NO: 684 - RNA, 25 nt, Artificial Sequence
  Synthetic oligonucleotide
aaugccaccgccaucuucuuccugc

SEQ ID NO: 685 - RNA, 25 nt, Artificial Sequence
  Synthetic oligonucleotide
ccaccgccaucuucuuccugccuga

SEQ ID NO: 686 - RNA, 25 nt, Artificial Sequence
  Synthetic oligonucleotide
caccgccaucuucuuccugccugau

SEQ ID NO: 687 - RNA, 25 nt, Artificial Sequence
  Synthetic oligonucleotide
accgccaucuucuuccugccugaug

SEQ ID NO: 688 - RNA, 25 nt, Artificial Sequence
  Synthetic oligonucleotide
ccgccaucuucuuccugccugauga

SEQ ID NO: 689 - RNA, 25 nt, Artificial Sequence
  Synthetic oligonucleotide
cgccaucuucuuccugccugaugag

SEQ ID NO: 690 - RNA, 25 nt, Artificial Sequence
  Synthetic oligonucleotide
gccaucuucuuccugccugaugagg

SEQ ID NO: 691 - RNA, 25 nt, Artificial Sequence
  Synthetic oligonucleotide
aucuucuuccugccugaugagggga

SEQ ID NO: 692 - RNA, 25 nt, Artificial Sequence
  Synthetic oligonucleotide
cuuccugccugaugaggggaaacua

SEQ ID NO: 693 - RNA, 25 nt, Artificial Sequence
  Synthetic oligonucleotide
uuccugccugaugaggggaaacuac

SEQ ID NO: 694 - RNA, 25 nt, Artificial Sequence
  Synthetic oligonucleotide
uccugccugaugaggggaaacuaca

SEQ ID NO: 695 - RNA, 25 nt, Artificial Sequence
  Synthetic oligonucleotide
ccugccugaugaggggaaacuacag

SEQ ID NO: 696 - RNA, 25 nt, Artificial Sequence
  Synthetic oligonucleotide
cugccugaugaggggaaacuacagc

SEQ ID NO: 697 - RNA, 25 nt, Artificial Sequence
  Synthetic oligonucleotide
ugccugaugaggggaaacuacagca

SEQ ID NO: 698 - RNA, 25 nt, Artificial Sequence
  Synthetic oligonucleotide
agcaccuggaaaaugaacucaccca

SEQ ID NO: 699 - RNA, 25 nt, Artificial Sequence
  Synthetic oligonucleotide
gcaccuggaaaaugaacucacccac

SEQ ID NO: 700 - RNA, 25 nt, Artificial Sequence
  Synthetic oligonucleotide
caccuggaaaaugaacucacccacg

SEQ ID NO: 701 - RNA, 25 nt, Artificial Sequence
  Synthetic oligonucleotide
accuggaaaaugaacucacccacga

SEQ ID NO: 702 - RNA, 25 nt, Artificial Sequence
  Synthetic oligonucleotide
ccuggaaaaugaacucacccacgau

SEQ ID NO: 703 - RNA, 25 nt, Artificial Sequence
  Synthetic oligonucleotide
auaucaucaccaaguuccuggaaaa

SEQ ID NO: 704 - RNA, 25 nt, Artificial Sequence
  Synthetic oligonucleotide
uaucaucaccaaguuccuggaaaau

SEQ ID NO: 705 - RNA, 25 nt, Artificial Sequence
  Synthetic oligonucleotide
aucaucaccaaguuccuggaaaaug

SEQ ID NO: 706 - RNA, 25 nt, Artificial Sequence
  Synthetic oligonucleotide
ucaucaccaaguuccuggaaaauga

SEQ ID NO: 707 - RNA, 25 nt, Artificial Sequence
  Synthetic oligonucleotide
caucaccaaguuccuggaaaaugaa

SEQ ID NO: 708 - RNA, 25 nt, Artificial Sequence
  Synthetic oligonucleotide
aucaccaaguuccuggaaaaugaag

SEQ ID NO: 709 - RNA, 25 nt, Artificial Sequence
  Synthetic oligonucleotide
ucaccaaguuccuggaaaaugaaga

SEQ ID NO: 710 - RNA, 25 nt, Artificial Sequence
  Synthetic oligonucleotide
caccaaguuccuggaaaaugaagac

SEQ ID NO: 711 - RNA, 25 nt, Artificial Sequence
  Synthetic oligonucleotide
accaaguuccuggaaaaugaagaca

SEQ ID NO: 712 - RNA, 25 nt, Artificial Sequence
  Synthetic oligonucleotide
ccaaguuccuggaaaaugaagacag

SEQ ID NO: 713 - RNA, 25 nt, Artificial Sequence
  Synthetic oligonucleotide
aggucuucagcaauggggcugaccu

SEQ ID NO: 714 - RNA, 25 nt, Artificial Sequence
  Synthetic oligonucleotide
caauggggcugaccucuccgggguc

SEQ ID NO: 715 - RNA, 25 nt, Artificial Sequence
  Synthetic oligonucleotide
aauggggcugaccucuccgggguca

SEQ ID NO: 716 - RNA, 25 nt, Artificial Sequence
  Synthetic oligonucleotide
auggggcugaccucuccggggucac

SEQ ID NO: 717 - RNA, 25 nt, Artificial Sequence
  Synthetic oligonucleotide
gaggaggcaccccugaagcucucca

SEQ ID NO: 718 - RNA, 25 nt, Artificial Sequence
  Synthetic oligonucleotide
ggaggcaccccugaagcucuccaag

SEQ ID NO: 719 - RNA, 25 nt, Artificial Sequence
  Synthetic oligonucleotide
cugaagcucuccaaggccgugcaua

SEQ ID NO: 720 - RNA, 25 nt, Artificial Sequence
  Synthetic oligonucleotide
cgugcauaaggcugugcugaccauc

SEQ ID NO: 721 - RNA, 25 nt, Artificial Sequence
  Synthetic oligonucleotide
gugcauaaggcugugcugaccaucg

SEQ ID NO: 722 - RNA, 25 nt, Artificial Sequence
  Synthetic oligonucleotide
ugcauaaggcugugcugaccaucga

SEQ ID NO: 723 - RNA, 25 nt, Artificial Sequence
  Synthetic oligonucleotide
gcauaaggcugugcugaccaucgac

SEQ ID NO: 724 - RNA, 25 nt, Artificial Sequence
  Synthetic oligonucleotide
cauaaggcugugcugaccaucgacg

SEQ ID NO: 725 - RNA, 25 nt, Artificial Sequence
  Synthetic oligonucleotide
auaaggcugugcugaccaucgacga

SEQ ID NO: 726 - RNA, 25 nt, Artificial Sequence
  Synthetic oligonucleotide
uaaggcugugcugaccaucgacgag

SEQ ID NO: 727 - RNA, 25 nt, Artificial Sequence
  Synthetic oligonucleotide
aaggcugugcugaccaucgacgaga

SEQ ID NO: 728 - RNA, 25 nt, Artificial Sequence
  Synthetic oligonucleotide
aggcugugcugaccaucgacgagaa

SEQ ID NO: 729 - RNA, 25 nt, Artificial Sequence
  Synthetic oligonucleotide
acugaagcugcuggggccauguuuu

SEQ ID NO: 730 - RNA, 25 nt, Artificial Sequence
  Synthetic oligonucleotide
cugaagcugcuggggccauguuuuu

SEQ ID NO: 731 - RNA, 25 nt, Artificial Sequence
  Synthetic oligonucleotide
ugaagcugcuggggccauguuuuua

SEQ ID NO: 732 - RNA, 25 nt, Artificial Sequence
  Synthetic oligonucleotide
gaagcugcuggggccauguuuuuag

SEQ ID NO: 733 - RNA, 25 nt, Artificial Sequence
  Synthetic oligonucleotide
aagcugcuggggccauguuuuuaga

SEQ ID NO: 734 - RNA, 25 nt, Artificial Sequence
  Synthetic oligonucleotide
agcugcuggggccauguuuuuagag

SEQ ID NO: 735 - RNA, 25 nt, Artificial Sequence
  Synthetic oligonucleotide
gccauguuuuuagaggccauaccca

SEQ ID NO: 736 - RNA, 25 nt, Artificial Sequence
  Synthetic oligonucleotide
ccauguuuuuagaggccauacccau

SEQ ID NO: 737 - RNA, 25 nt, Artificial Sequence
  Synthetic oligonucleotide
cauguuuuuagaggccauacccaug

SEQ ID NO: 738 - RNA, 25 nt, Artificial Sequence
  Synthetic oligonucleotide
auguuuuuagaggccauacccaugu

SEQ ID NO: 739 - RNA, 25 nt, Artificial Sequence
  Synthetic oligonucleotide
uguuuuuagaggccauacccauguc

SEQ ID NO: 740 - RNA, 25 nt, Artificial Sequence
  Synthetic oligonucleotide
guuuuuagaggccauacccaugucu

SEQ ID NO: 741 - RNA, 25 nt, Artificial Sequence
  Synthetic oligonucleotide
uuuuuagaggccauacccaugucua

SEQ ID NO: 742 - RNA, 25 nt, Artificial Sequence
  Synthetic oligonucleotide
uuuuagaggccauacccaugucuau

SEQ ID NO: 743 - RNA, 25 nt, Artificial Sequence
  Synthetic oligonucleotide
uuuagaggccauacccaugucuauc

SEQ ID NO: 744 - RNA, 25 nt, Artificial Sequence
  Synthetic oligonucleotide
uuagaggccauacccaugucuaucc

SEQ ID NO: 745 - RNA, 25 nt, Artificial Sequence
  Synthetic oligonucleotide
uagaggccauacccaugucuauccc

SEQ ID NO: 746 - RNA, 25 nt, Artificial Sequence
  Synthetic oligonucleotide
agaggccauacccaugucuaucccc

SEQ ID NO: 747 - RNA, 25 nt, Artificial Sequence
  Synthetic oligonucleotide
guucaacaaacccuuugucuucuua

SEQ ID NO: 748 - RNA, 25 nt, Artificial Sequence
  Synthetic oligonucleotide
uucaacaaacccuuugucuucuuaa

SEQ ID NO: 749 - RNA, 25 nt, Artificial Sequence
  Synthetic oligonucleotide
ucaacaaacccuuugucuucuuaau

SEQ ID NO: 750 - RNA, 25 nt, Artificial Sequence
  Synthetic oligonucleotide
caacaaacccuuugucuucuuaaug

SEQ ID NO: 751 - RNA, 25 nt, Artificial Sequence
  Synthetic oligonucleotide
aacaaacccuuugucuucuuaauga

SEQ ID NO: 752 - RNA, 25 nt, Artificial Sequence
  Synthetic oligonucleotide
acaaacccuuugucuucuuaaugau

SEQ ID NO: 753 - RNA, 25 nt, Artificial Sequence
  Synthetic oligonucleotide
caaacccuuugucuucuuaaugauu

SEQ ID NO: 754 - RNA, 25 nt, Artificial Sequence
  Synthetic oligonucleotide
aaacccuuugucuucuuaaugauug

SEQ ID NO: 755 - RNA, 25 nt, Artificial Sequence
  Synthetic oligonucleotide
aacccuuugucuucuuaaugauuga

SEQ ID NO: 756 - RNA, 25 nt, Artificial Sequence
  Synthetic oligonucleotide
aauaccaagucuccccucuucaugg

SEQ ID NO: 757 - RNA, 25 nt, Artificial Sequence
  Synthetic oligonucleotide
auaccaagucuccccucuucauggg

SEQ ID NO: 758 - RNA, 25 nt, Artificial Sequence
  Synthetic oligonucleotide
uaccaagucuccccucuucauggga

SEQ ID NO: 759 - RNA, 25 nt, Artificial Sequence
  Synthetic oligonucleotide
accaagucuccccucuucaugggaa

SEQ ID NO: 760 - RNA, 25 nt, Artificial Sequence
  Synthetic oligonucleotide
ccaagucuccccucuucaugggaaa

SEQ ID NO: 761 - RNA, 25 nt, Artificial Sequence
  Synthetic oligonucleotide
caagucuccccucuucaugggaaaa

SEQ ID NO: 762 - RNA, 25 nt, Artificial Sequence
  Synthetic oligonucleotide
aagucuccccucuucaugggaaaag

SEQ ID NO: 763 - RNA, 25 nt, Artificial Sequence
  Synthetic oligonucleotide
agucuccccucuucaugggaaaagu

SEQ ID NO: 764 - RNA, 25 nt, Artificial Sequence
  Synthetic oligonucleotide
gucuccccucuucaugggaaaagug

SEQ ID NO: 765 - RNA, 25 nt, Artificial Sequence
  Synthetic oligonucleotide
cuccccucuucaugggaaaaguggu

SEQ ID NO: 766 - RNA, 25 nt, Artificial Sequence
  Synthetic oligonucleotide
ccccucuucaugggaaaagugguga

SEQ ID NO: 767 - RNA, 25 nt, Artificial Sequence
  Synthetic oligonucleotide
cccucuucaugggaaaaguggugaa

SEQ ID NO: 768 - RNA, 25 nt, Artificial Sequence
  Synthetic oligonucleotide
ccucuucaugggaaaaguggugaau

SEQ ID NO: 769 - RNA, 25 nt, Artificial Sequence
  Synthetic oligonucleotide
cucuucaugggaaaaguggugaauc

SEQ ID NO: 770 - RNA, 25 nt, Artificial Sequence
  Synthetic oligonucleotide
ucuucaugggaaaaguggugaaucc

SEQ ID NO: 771 - RNA, 25 nt, Artificial Sequence
  Synthetic oligonucleotide
cuucaugggaaaaguggugaauccc

SEQ ID NO: 772 - RNA, 25 nt, Artificial Sequence
  Synthetic oligonucleotide
uucaugggaaaaguggugaauccca

SEQ ID NO: 773 - RNA, 25 nt, Artificial Sequence
  Synthetic oligonucleotide
ucaugggaaaaguggugaaucccac

SEQ ID NO: 774 - RNA, 25 nt, Artificial Sequence
  Synthetic oligonucleotide
caugggaaaaguggugaaucccacc

SEQ ID NO: 775 - RNA, 25 nt, Artificial Sequence
  Synthetic oligonucleotide
augggaaaaguggugaaucccaccc

SEQ ID NO: 776 - RNA, 25 nt, Artificial Sequence
  Synthetic oligonucleotide
ugggaaaaguggugaaucccaccca

SEQ ID NO: 777 - RNA, 25 nt, Artificial Sequence
  Synthetic oligonucleotide
gggaaaaguggugaaucccacccaa

SEQ ID NO: 778 - RNA, 25 nt, Artificial Sequence
  Synthetic oligonucleotide
ggaaaaguggugaaucccacccaaa

SEQ ID NO: 779 - RNA, 25 nt, Artificial Sequence
  Synthetic oligonucleotide
gaaaaguggugaaucccacccaaaa

SEQ ID NO: 780 - RNA, 25 nt, Artificial Sequence
  Synthetic oligonucleotide
aaaaguggugaaucccacccaaaaa

SEQ ID NO: 781 - RNA, 25 nt, Artificial Sequence
  Synthetic oligonucleotide
aaaguggugaaucccacccaaaaau

SEQ ID NO: 782 - RNA, 25 nt, Artificial Sequence
  Synthetic oligonucleotide
aaguggugaaucccacccaaaaaua

SEQ ID NO: 783 - RNA, 25 nt, Artificial Sequence
  Synthetic oligonucleotide
cgauaguucaaaauggugaaauuag

SEQ ID NO: 784 - RNA, 25 nt, Artificial Sequence
  Synthetic oligonucleotide
caaaauggugaaauuagcaauucua

SEQ ID NO: 785 - RNA, 25 nt, Artificial Sequence
  Synthetic oligonucleotide
uugguaugauguucaaguuagauaa

SEQ ID NO: 786 - RNA, 25 nt, Artificial Sequence
  Synthetic oligonucleotide
gguaugauguucaaguuagauaaca

SEQ ID NO: 787 - RNA, 25 nt, Artificial Sequence
  Synthetic oligonucleotide
guaugauguucaaguuagauaacaa

SEQ ID NO: 788 - RNA, 25 nt, Artificial Sequence
  Synthetic oligonucleotide
augauguucaaguuagauaacaaaa

SEQ ID NO: 789 - RNA, 25 nt, Artificial Sequence
  Synthetic oligonucleotide
auguucaaguuagauaacaaaaugu

SEQ ID NO: 790 - RNA, 25 nt, Artificial Sequence
  Synthetic oligonucleotide
caaguuagauaacaaaauguuuaua

SEQ ID NO: 791 - RNA, 25 nt, Artificial Sequence
  Synthetic oligonucleotide
aaguuagauaacaaaauguuuauac

SEQ ID NO: 792 - RNA, 25 nt, Artificial Sequence
  Synthetic oligonucleotide
aguuagauaacaaaauguuuauacc

SEQ ID NO: 793 - RNA, 21 nt, Artificial Sequence
  Synthetic oligonucleotide
uacaucccaccaugaucagga

SEQ ID NO: 794 - RNA, 21 nt, Artificial Sequence
  Synthetic oligonucleotide
gccagcuggcacaccagucca

SEQ ID NO: 795 - RNA, 21 nt, Artificial Sequence
  Synthetic oligonucleotide
cagcuggcacaccaguccaac

SEQ ID NO: 796 - RNA, 21 nt, Artificial Sequence
  Synthetic oligonucleotide
cuggcacaccaguccaacagc

SEQ ID NO: 797 - RNA, 21 nt, Artificial Sequence
  Synthetic oligonucleotide
uggcacaccaguccaacagca

SEQ ID NO: 798 - RNA, 21 nt, Artificial Sequence
  Synthetic oligonucleotide
ggcacaccaguccaacagcac

SEQ ID NO: 799 - RNA, 21 nt, Artificial Sequence
  Synthetic oligonucleotide
gcacaccaguccaacagcacc

SEQ ID NO: 800 - RNA, 21 nt, Artificial Sequence
  Synthetic oligonucleotide
cacaccaguccaacagcacca

SEQ ID NO: 801 - RNA, 21 nt, Artificial Sequence
  Synthetic oligonucleotide
caccaauaucuucuucucccc

SEQ ID NO: 802 - RNA, 21 nt, Artificial Sequence
  Synthetic oligonucleotide
accaauaucuucuucucccca

SEQ ID NO: 803 - RNA, 21 nt, Artificial Sequence
  Synthetic oligonucleotide
ccaauaucuucuucuccccag

SEQ ID NO: 804 - RNA, 21 nt, Artificial Sequence
  Synthetic oligonucleotide
caauaucuucuucuccccagu

SEQ ID NO: 805 - RNA, 21 nt, Artificial Sequence
  Synthetic oligonucleotide
aauaucuucuucuccccagug

SEQ ID NO: 806 - RNA, 21 nt, Artificial Sequence
  Synthetic oligonucleotide
auaucuucuucuccccaguga

SEQ ID NO: 807 - RNA, 21 nt, Artificial Sequence
  Synthetic oligonucleotide
uaucuucuucuccccagugag

SEQ ID NO: 808 - RNA, 21 nt, Artificial Sequence
  Synthetic oligonucleotide
aucuucuucuccccagugagc

SEQ ID NO: 809 - RNA, 21 nt, Artificial Sequence
  Synthetic oligonucleotide
ucuucuucuccccagugagca

SEQ ID NO: 810 - RNA, 21 nt, Artificial Sequence
  Synthetic oligonucleotide
cuucuucuccccagugagcau

SEQ ID NO: 811 - RNA, 21 nt, Artificial Sequence
  Synthetic oligonucleotide
uucuucuccccagugagcauc

SEQ ID NO: 812 - RNA, 21 nt, Artificial Sequence
  Synthetic oligonucleotide
cuucuccccagugagcaucgc

SEQ ID NO: 813 - RNA, 21 nt, Artificial Sequence
  Synthetic oligonucleotide
uucuccccagugagcaucgcu

SEQ ID NO: 814 - RNA, 21 nt, Artificial Sequence
  Synthetic oligonucleotide
cuccccagugagcaucgcuac

SEQ ID NO: 815 - RNA, 21 nt, Artificial Sequence
  Synthetic oligonucleotide
cuacagccuuugcaaugcucu

SEQ ID NO: 816 - RNA, 21 nt, Artificial Sequence
  Synthetic oligonucleotide
uuugcaaugcucucccugggg

SEQ ID NO: 817 - RNA, 21 nt, Artificial Sequence
  Synthetic oligonucleotide
ugaaauccuggagggccugaa

SEQ ID NO: 818 - RNA, 21 nt, Artificial Sequence
  Synthetic oligonucleotide
gaaauccuggagggccugaau

SEQ ID NO: 819 - RNA, 21 nt, Artificial Sequence
  Synthetic oligonucleotide
aaauccuggagggccugaauu

SEQ ID NO: 820 - RNA, 21 nt, Artificial Sequence
  Synthetic oligonucleotide
auccuggagggccugaauuuc

SEQ ID NO: 821 - RNA, 21 nt, Artificial Sequence
  Synthetic oligonucleotide
uccuggagggccugaauuuca

SEQ ID NO: 822 - RNA, 21 nt, Artificial Sequence
  Synthetic oligonucleotide
ccuggagggccugaauuucaa

SEQ ID NO: 823 - RNA, 21 nt, Artificial Sequence
  Synthetic oligonucleotide
uccaugaaggcuuccaggaac

SEQ ID NO: 824 - RNA, 21 nt, Artificial Sequence
  Synthetic oligonucleotide
augaaggcuuccaggaacucc

SEQ ID NO: 825 - RNA, 21 nt, Artificial Sequence
  Synthetic oligonucleotide
ugaaggcuuccaggaacuccu

SEQ ID NO: 826 - RNA, 21 nt, Artificial Sequence
  Synthetic oligonucleotide
ccagccagacagccagcucca

SEQ ID NO: 827 - RNA, 21 nt, Artificial Sequence
  Synthetic oligonucleotide
agccagacagccagcuccagc

SEQ ID NO: 828 - RNA, 21 nt, Artificial Sequence
  Synthetic oligonucleotide
ccagacagccagcuccagcug

SEQ ID NO: 829 - RNA, 21 nt, Artificial Sequence
  Synthetic oligonucleotide
cagacagccagcuccagcuga

SEQ ID NO: 830 - RNA, 21 nt, Artificial Sequence
  Synthetic oligonucleotide
gcuaguggauaaguuuuugga

SEQ ID NO: 831 - RNA, 21 nt, Artificial Sequence
  Synthetic oligonucleotide
cuaguggauaaguuuuuggag

SEQ ID NO: 832 - RNA, 21 nt, Artificial Sequence
  Synthetic oligonucleotide
uaguggauaaguuuuuggagg

SEQ ID NO: 833 - RNA, 21 nt, Artificial Sequence
  Synthetic oligonucleotide
aguggauaaguuuuuggagga

SEQ ID NO: 834 - RNA, 21 nt, Artificial Sequence
  Synthetic oligonucleotide
guggauaaguuuuuggaggau

SEQ ID NO: 835 - RNA, 21 nt, Artificial Sequence
  Synthetic oligonucleotide
uggauaaguuuuuggaggaug

SEQ ID NO: 836 - RNA, 21 nt, Artificial Sequence
  Synthetic oligonucleotide
ggauaaguuuuuggaggaugu

SEQ ID NO: 837 - RNA, 21 nt, Artificial Sequence
  Synthetic oligonucleotide
guuguaccacucagaagccuu

SEQ ID NO: 838 - RNA, 21 nt, Artificial Sequence
  Synthetic oligonucleotide
uuguaccacucagaagccuuc

SEQ ID NO: 839 - RNA, 21 nt, Artificial Sequence
  Synthetic oligonucleotide
guacucaagggaaaauugugg

SEQ ID NO: 840 - RNA, 21 nt, Artificial Sequence
  Synthetic oligonucleotide
uacucaagggaaaauugugga

SEQ ID NO: 841 - RNA, 21 nt, Artificial Sequence
  Synthetic oligonucleotide
acucaagggaaaauuguggau

SEQ ID NO: 842 - RNA, 21 nt, Artificial Sequence
  Synthetic oligonucleotide
cucaagggaaaauuguggauu

SEQ ID NO: 843 - RNA, 21 nt, Artificial Sequence
  Synthetic oligonucleotide
ucaagggaaaauuguggauuu

SEQ ID NO: 844 - RNA, 21 nt, Artificial Sequence
  Synthetic oligonucleotide
caagggaaaauuguggauuug

SEQ ID NO: 845 - RNA, 21 nt, Artificial Sequence
  Synthetic oligonucleotide
aagggaaaauuguggauuugg

SEQ ID NO: 846 - RNA, 21 nt, Artificial Sequence
  Synthetic oligonucleotide
agggaaaauuguggauuuggu

SEQ ID NO: 847 - RNA, 21 nt, Artificial Sequence
  Synthetic oligonucleotide
gggaaaauuguggauuugguc

SEQ ID NO: 848 - RNA, 21 nt, Artificial Sequence
  Synthetic oligonucleotide
ggaaaauuguggauuugguca

SEQ ID NO: 849 - RNA, 21 nt, Artificial Sequence
  Synthetic oligonucleotide
gaaaauuguggauuuggucaa

SEQ ID NO: 850 - RNA, 21 nt, Artificial Sequence
  Synthetic oligonucleotide
aaaauuguggauuuggucaag

SEQ ID NO: 851 - RNA, 21 nt, Artificial Sequence
  Synthetic oligonucleotide
aaauuguggauuuggucaagg

SEQ ID NO: 852 - RNA, 21 nt, Artificial Sequence
  Synthetic oligonucleotide
aauuguggauuuggucaagga

SEQ ID NO: 853 - RNA, 21 nt, Artificial Sequence
  Synthetic oligonucleotide
auuguggauuuggucaaggag

SEQ ID NO: 854 - RNA, 21 nt, Artificial Sequence
  Synthetic oligonucleotide
uuguggauuuggucaaggagc

SEQ ID NO: 855 - RNA, 21 nt, Artificial Sequence
  Synthetic oligonucleotide
uguggauuuggucaaggagcu

SEQ ID NO: 856 - RNA, 21 nt, Artificial Sequence
  Synthetic oligonucleotide
guggauuuggucaaggagcuu

SEQ ID NO: 857 - RNA, 21 nt, Artificial Sequence
  Synthetic oligonucleotide
uggauuuggucaaggagcuug

SEQ ID NO: 858 - RNA, 21 nt, Artificial Sequence
  Synthetic oligonucleotide
ggauuuggucaaggagcuuga

SEQ ID NO: 859 - RNA, 21 nt, Artificial Sequence
  Synthetic oligonucleotide
gauuuggucaaggagcuugac

SEQ ID NO: 860 - RNA, 21 nt, Artificial Sequence
  Synthetic oligonucleotide
auuuggucaaggagcuugaca

SEQ ID NO: 861 - RNA, 21 nt, Artificial Sequence
  Synthetic oligonucleotide
uuuggucaaggagcuugacag

SEQ ID NO: 862 - RNA, 21 nt, Artificial Sequence
  Synthetic oligonucleotide
cacaguuuuugcucuggugaa

SEQ ID NO: 863 - RNA, 21 nt, Artificial Sequence
  Synthetic oligonucleotide
acaguuuuugcucuggugaau

SEQ ID NO: 864 - RNA, 21 nt, Artificial Sequence
  Synthetic oligonucleotide
caguuuuugcucuggugaauu

SEQ ID NO: 865 - RNA, 21 nt, Artificial Sequence
  Synthetic oligonucleotide
aguuuuugcucuggugaauua

SEQ ID NO: 866 - RNA, 21 nt, Artificial Sequence
  Synthetic oligonucleotide
uuaaaggcaaaugggagagac

SEQ ID NO: 867 - RNA, 21 nt, Artificial Sequence
  Synthetic oligonucleotide
uaaaggcaaaugggagagacc

SEQ ID NO: 868 - RNA, 21 nt, Artificial Sequence
  Synthetic oligonucleotide
aaaggcaaaugggagagaccc

SEQ ID NO: 869 - RNA, 21 nt, Artificial Sequence
  Synthetic oligonucleotide
aaggcaaaugggagagacccu

SEQ ID NO: 870 - RNA, 21 nt, Artificial Sequence
  Synthetic oligonucleotide
cgaggaagaggacuuccacgu

SEQ ID NO: 871 - RNA, 21 nt, Artificial Sequence
  Synthetic oligonucleotide
gaggaagaggacuuccacgug

SEQ ID NO: 872 - RNA, 21 nt, Artificial Sequence
  Synthetic oligonucleotide
aggaagaggacuuccacgugg

SEQ ID NO: 873 - RNA, 21 nt, Artificial Sequence
  Synthetic oligonucleotide
ggaagaggacuuccacgugga

SEQ ID NO: 874 - RNA, 21 nt, Artificial Sequence
  Synthetic oligonucleotide
aagaggacuuccacguggacc

SEQ ID NO: 875 - RNA, 21 nt, Artificial Sequence
  Synthetic oligonucleotide
agaggacuuccacguggacca

SEQ ID NO: 876 - RNA, 21 nt, Artificial Sequence
  Synthetic oligonucleotide
aggacuuccacguggaccagg

SEQ ID NO: 877 - RNA, 21 nt, Artificial Sequence
  Synthetic oligonucleotide
gcguuuaggcauguuuaacau

SEQ ID NO: 878 - RNA, 21 nt, Artificial Sequence
  Synthetic oligonucleotide
cguuuaggcauguuuaacauc

SEQ ID NO: 879 - RNA, 21 nt, Artificial Sequence
  Synthetic oligonucleotide
aagcuguccagcugggugcug

SEQ ID NO: 880 - RNA, 21 nt, Artificial Sequence
  Synthetic oligonucleotide
agcuguccagcugggugcugc

SEQ ID NO: 881 - RNA, 21 nt, Artificial Sequence
  Synthetic oligonucleotide
ggcaaugccaccgccaucuuc

SEQ ID NO: 882 - RNA, 21 nt, Artificial Sequence
  Synthetic oligonucleotide
gcaaugccaccgccaucuucu

SEQ ID NO: 883 - RNA, 21 nt, Artificial Sequence
  Synthetic oligonucleotide
ugccaccgccaucuucuuccu

SEQ ID NO: 884 - RNA, 21 nt, Artificial Sequence
  Synthetic oligonucleotide
gccaccgccaucuucuuccug

SEQ ID NO: 885 - RNA, 21 nt, Artificial Sequence
  Synthetic oligonucleotide
ccaccgccaucuucuuccugc

SEQ ID NO: 886 - RNA, 21 nt, Artificial Sequence
  Synthetic oligonucleotide
caccgccaucuucuuccugcc

SEQ ID NO: 887 - RNA, 21 nt, Artificial Sequence
  Synthetic oligonucleotide
accgccaucuucuuccugccu

SEQ ID NO: 888 - RNA, 21 nt, Artificial Sequence
  Synthetic oligonucleotide
ccgccaucuucuuccugccug

SEQ ID NO: 889 - RNA, 21 nt, Artificial Sequence
  Synthetic oligonucleotide
ccaucuucuuccugccugaug

SEQ ID NO: 890 - RNA, 21 nt, Artificial Sequence
  Synthetic oligonucleotide
uucuuccugccugaugagggg

SEQ ID NO: 891 - RNA, 21 nt, Artificial Sequence
  Synthetic oligonucleotide
ucuuccugccugaugagggga

SEQ ID NO: 892 - RNA, 21 nt, Artificial Sequence
  Synthetic oligonucleotide
cuuccugccugaugaggggaa

SEQ ID NO: 893 - RNA, 21 nt, Artificial Sequence
  Synthetic oligonucleotide
uuccugccugaugaggggaaa

SEQ ID NO: 894 - RNA, 21 nt, Artificial Sequence
  Synthetic oligonucleotide
uccugccugaugaggggaaac

SEQ ID NO: 895 - RNA, 21 nt, Artificial Sequence
  Synthetic oligonucleotide
ccugccugaugaggggaaacu

SEQ ID NO: 896 - RNA, 21 nt, Artificial Sequence
  Synthetic oligonucleotide
acagcaccuggaaaaugaacu

SEQ ID NO: 897 - RNA, 21 nt, Artificial Sequence
  Synthetic oligonucleotide
cagcaccuggaaaaugaacuc

SEQ ID NO: 898 - RNA, 21 nt, Artificial Sequence
  Synthetic oligonucleotide
agcaccuggaaaaugaacuca

SEQ ID NO: 899 - RNA, 21 nt, Artificial Sequence
  Synthetic oligonucleotide
gcaccuggaaaaugaacucac

SEQ ID NO: 900 - RNA, 21 nt, Artificial Sequence
  Synthetic oligonucleotide
caccuggaaaaugaacucacc

SEQ ID NO: 901 - RNA, 21 nt, Artificial Sequence
  Synthetic oligonucleotide
cgauaucaucaccaaguuccu

SEQ ID NO: 902 - RNA, 21 nt, Artificial Sequence
  Synthetic oligonucleotide
gauaucaucaccaaguuccug

SEQ ID NO: 903 - RNA, 21 nt, Artificial Sequence
  Synthetic oligonucleotide
auaucaucaccaaguuccugg

SEQ ID NO: 904 - RNA, 21 nt, Artificial Sequence
  Synthetic oligonucleotide
uaucaucaccaaguuccugga

SEQ ID NO: 905 - RNA, 21 nt, Artificial Sequence
  Synthetic oligonucleotide
aucaucaccaaguuccuggaa

SEQ ID NO: 906 - RNA, 21 nt, Artificial Sequence
  Synthetic oligonucleotide
ucaucaccaaguuccuggaaa

SEQ ID NO: 907 - RNA, 21 nt, Artificial Sequence
  Synthetic oligonucleotide
caucaccaaguuccuggaaaa

SEQ ID NO: 908 - RNA, 21 nt, Artificial Sequence
  Synthetic oligonucleotide
aucaccaaguuccuggaaaau

SEQ ID NO: 909 - RNA, 21 nt, Artificial Sequence
  Synthetic oligonucleotide
ucaccaaguuccuggaaaaug

SEQ ID NO: 910 - RNA, 21 nt, Artificial Sequence
  Synthetic oligonucleotide
caccaaguuccuggaaaauga

SEQ ID NO: 911 - RNA, 21 nt, Artificial Sequence
  Synthetic oligonucleotide
uaaggucuucagcaauggggc

SEQ ID NO: 912 - RNA, 21 nt, Artificial Sequence
  Synthetic oligonucleotide
agcaauggggcugaccucucc

SEQ ID NO: 913 - RNA, 21 nt, Artificial Sequence
  Synthetic oligonucleotide
gcaauggggcugaccucuccg

SEQ ID NO: 914 - RNA, 21 nt, Artificial Sequence
  Synthetic oligonucleotide
caauggggcugaccucuccgg

SEQ ID NO: 915 - RNA, 21 nt, Artificial Sequence
  Synthetic oligonucleotide
cagaggaggcaccccugaagc

SEQ ID NO: 916 - RNA, 21 nt, Artificial Sequence
  Synthetic oligonucleotide
gaggaggcaccccugaagcuc

SEQ ID NO: 917 - RNA, 21 nt, Artificial Sequence
  Synthetic oligonucleotide
cccugaagcucuccaaggccg

SEQ ID NO: 918 - RNA, 21 nt, Artificial Sequence
  Synthetic oligonucleotide
gccgugcauaaggcugugcug

SEQ ID NO: 919 - RNA, 21 nt, Artificial Sequence
  Synthetic oligonucleotide
ccgugcauaaggcugugcuga

SEQ ID NO: 920 - RNA, 21 nt, Artificial Sequence
  Synthetic oligonucleotide
cgugcauaaggcugugcugac

SEQ ID NO: 921 - RNA, 21 nt, Artificial Sequence
  Synthetic oligonucleotide
gugcauaaggcugugcugacc

SEQ ID NO: 922 - RNA, 21 nt, Artificial Sequence
  Synthetic oligonucleotide
ugcauaaggcugugcugacca

SEQ ID NO: 923 - RNA, 21 nt, Artificial Sequence
  Synthetic oligonucleotide
gcauaaggcugugcugaccau

SEQ ID NO: 924 - RNA, 21 nt, Artificial Sequence
  Synthetic oligonucleotide
cauaaggcugugcugaccauc

SEQ ID NO: 925 - RNA, 21 nt, Artificial Sequence
  Synthetic oligonucleotide
auaaggcugugcugaccaucg

SEQ ID NO: 926 - RNA, 21 nt, Artificial Sequence
  Synthetic oligonucleotide
uaaggcugugcugaccaucga

SEQ ID NO: 927 - RNA, 21 nt, Artificial Sequence
  Synthetic oligonucleotide
ggacugaagcugcuggggcca

SEQ ID NO: 928 - RNA, 21 nt, Artificial Sequence
  Synthetic oligonucleotide
gacugaagcugcuggggccau

SEQ ID NO: 929 - RNA, 21 nt, Artificial Sequence
  Synthetic oligonucleotide
acugaagcugcuggggccaug

SEQ ID NO: 930 - RNA, 21 nt, Artificial Sequence
  Synthetic oligonucleotide
cugaagcugcuggggccaugu

SEQ ID NO: 931 - RNA, 21 nt, Artificial Sequence
  Synthetic oligonucleotide
ugaagcugcuggggccauguu

SEQ ID NO: 932 - RNA, 21 nt, Artificial Sequence
  Synthetic oligonucleotide
gaagcugcuggggccauguuu

SEQ ID NO: 933 - RNA, 21 nt, Artificial Sequence
  Synthetic oligonucleotide
gggccauguuuuuagaggcca

SEQ ID NO: 934 - RNA, 21 nt, Artificial Sequence
  Synthetic oligonucleotide
ggccauguuuuuagaggccau

SEQ ID NO: 935 - RNA, 21 nt, Artificial Sequence
  Synthetic oligonucleotide
gccauguuuuuagaggccaua

SEQ ID NO: 936 - RNA, 21 nt, Artificial Sequence
  Synthetic oligonucleotide
ccauguuuuuagaggccauac

SEQ ID NO: 937 - RNA, 21 nt, Artificial Sequence
  Synthetic oligonucleotide
cauguuuuuagaggccauacc

SEQ ID NO: 938 - RNA, 21 nt, Artificial Sequence
  Synthetic oligonucleotide
auguuuuuagaggccauaccc

SEQ ID NO: 939 - RNA, 21 nt, Artificial Sequence
  Synthetic oligonucleotide
uguuuuuagaggccauaccca

SEQ ID NO: 940 - RNA, 21 nt, Artificial Sequence
  Synthetic oligonucleotide
guuuuuagaggccauacccau

SEQ ID NO: 941 - RNA, 21 nt, Artificial Sequence
  Synthetic oligonucleotide
uuuuuagaggccauacccaug

SEQ ID NO: 942 - RNA, 21 nt, Artificial Sequence
  Synthetic oligonucleotide
uuuuagaggccauacccaugu

SEQ ID NO: 943 - RNA, 21 nt, Artificial Sequence
  Synthetic oligonucleotide
uuuagaggccauacccauguc

SEQ ID NO: 944 - RNA, 21 nt, Artificial Sequence
  Synthetic oligonucleotide
uuagaggccauacccaugucu

SEQ ID NO: 945 - RNA, 21 nt, Artificial Sequence
  Synthetic oligonucleotide
aaguucaacaaacccuuuguc

SEQ ID NO: 946 - RNA, 21 nt, Artificial Sequence
  Synthetic oligonucleotide
aguucaacaaacccuuugucu

SEQ ID NO: 947 - RNA, 21 nt, Artificial Sequence
  Synthetic oligonucleotide
guucaacaaacccuuugucuu

SEQ ID NO: 948 - RNA, 21 nt, Artificial Sequence
  Synthetic oligonucleotide
uucaacaaacccuuugucuuc

SEQ ID NO: 949 - RNA, 21 nt, Artificial Sequence
  Synthetic oligonucleotide
ucaacaaacccuuugucuucu

SEQ ID NO: 950 - RNA, 21 nt, Artificial Sequence
  Synthetic oligonucleotide
caacaaacccuuugucuucuu

SEQ ID NO: 951 - RNA, 21 nt, Artificial Sequence
  Synthetic oligonucleotide
aacaaacccuuugucuucuua

SEQ ID NO: 952 - RNA, 21 nt, Artificial Sequence
  Synthetic oligonucleotide
acaaacccuuugucuucuuaa

SEQ ID NO: 953 - RNA, 21 nt, Artificial Sequence
  Synthetic oligonucleotide
caaacccuuugucuucuuaau

SEQ ID NO: 954 - RNA, 21 nt, Artificial Sequence
  Synthetic oligonucleotide
aaaauaccaagucuccccucu

SEQ ID NO: 955 - RNA, 21 nt, Artificial Sequence
  Synthetic oligonucleotide
aaauaccaagucuccccucuu

SEQ ID NO: 956 - RNA, 21 nt, Artificial Sequence
  Synthetic oligonucleotide
aauaccaagucuccccucuuc

SEQ ID NO: 957 - RNA, 21 nt, Artificial Sequence
  Synthetic oligonucleotide
auaccaagucuccccucuuca

SEQ ID NO: 958 - RNA, 21 nt, Artificial Sequence
  Synthetic oligonucleotide
uaccaagucuccccucuucau

SEQ ID NO: 959 - RNA, 21 nt, Artificial Sequence
  Synthetic oligonucleotide
accaagucuccccucuucaug

SEQ ID NO: 960 - RNA, 21 nt, Artificial Sequence
  Synthetic oligonucleotide
ccaagucuccccucuucaugg

SEQ ID NO: 961 - RNA, 21 nt, Artificial Sequence
  Synthetic oligonucleotide
caagucuccccucuucauggg

SEQ ID NO: 962 - RNA, 21 nt, Artificial Sequence
  Synthetic oligonucleotide
aagucuccccucuucauggga

SEQ ID NO: 963 - RNA, 21 nt, Artificial Sequence
  Synthetic oligonucleotide
gucuccccucuucaugggaaa

SEQ ID NO: 964 - RNA, 21 nt, Artificial Sequence
  Synthetic oligonucleotide
cuccccucuucaugggaaaag

SEQ ID NO: 965 - RNA, 21 nt, Artificial Sequence
  Synthetic oligonucleotide
uccccucuucaugggaaaagu

SEQ ID NO: 966 - RNA, 21 nt, Artificial Sequence
  Synthetic oligonucleotide
ccccucuucaugggaaaagug

SEQ ID NO: 967 - RNA, 21 nt, Artificial Sequence
  Synthetic oligonucleotide
cccucuucaugggaaaagugg

SEQ ID NO: 968 - RNA, 21 nt, Artificial Sequence
  Synthetic oligonucleotide
ccucuucaugggaaaaguggu

SEQ ID NO: 969 - RNA, 21 nt, Artificial Sequence
  Synthetic oligonucleotide
cucuucaugggaaaaguggug

SEQ ID NO: 970 - RNA, 21 nt, Artificial Sequence
  Synthetic oligonucleotide
ucuucaugggaaaagugguga

SEQ ID NO: 971 - RNA, 21 nt, Artificial Sequence
  Synthetic oligonucleotide
cuucaugggaaaaguggugaa

SEQ ID NO: 972 - RNA, 21 nt, Artificial Sequence
  Synthetic oligonucleotide
uucaugggaaaaguggugaau

SEQ ID NO: 973 - RNA, 21 nt, Artificial Sequence
  Synthetic oligonucleotide
ucaugggaaaaguggugaauc

SEQ ID NO: 974 - RNA, 21 nt, Artificial Sequence
  Synthetic oligonucleotide
caugggaaaaguggugaaucc

SEQ ID NO: 975 - RNA, 21 nt, Artificial Sequence
  Synthetic oligonucleotide
augggaaaaguggugaauccc

SEQ ID NO: 976 - RNA, 21 nt, Artificial Sequence
  Synthetic oligonucleotide
ugggaaaaguggugaauccca

SEQ ID NO: 977 - RNA, 21 nt, Artificial Sequence
  Synthetic oligonucleotide
gggaaaaguggugaaucccac

SEQ ID NO: 978 - RNA, 21 nt, Artificial Sequence
  Synthetic oligonucleotide
ggaaaaguggugaaucccacc

SEQ ID NO: 979 - RNA, 21 nt, Artificial Sequence
  Synthetic oligonucleotide
gaaaaguggugaaucccaccc

SEQ ID NO: 980 - RNA, 21 nt, Artificial Sequence
  Synthetic oligonucleotide
aaaaguggugaaucccaccca

SEQ ID NO: 981 - RNA, 21 nt, Artificial Sequence
  Synthetic oligonucleotide
uucgauaguucaaaaugguga

SEQ ID NO: 982 - RNA, 21 nt, Artificial Sequence
  Synthetic oligonucleotide
uucaaaauggugaaauuagca

SEQ ID NO: 983 - RNA, 21 nt, Artificial Sequence
  Synthetic oligonucleotide
aguugguaugauguucaaguu

SEQ ID NO: 984 - RNA, 21 nt, Artificial Sequence
  Synthetic oligonucleotide
uugguaugauguucaaguuag

SEQ ID NO: 985 - RNA, 21 nt, Artificial Sequence
  Synthetic oligonucleotide
ugguaugauguucaaguuaga

SEQ ID NO: 986 - RNA, 21 nt, Artificial Sequence
  Synthetic oligonucleotide
guaugauguucaaguuagaua

SEQ ID NO: 987 - RNA, 21 nt, Artificial Sequence
  Synthetic oligonucleotide
ugauguucaaguuagauaaca

SEQ ID NO: 988 - RNA, 21 nt, Artificial Sequence
  Synthetic oligonucleotide
uucaaguuagauaacaaaaug

SEQ ID NO: 989 - RNA, 21 nt, Artificial Sequence
  Synthetic oligonucleotide
ucaaguuagauaacaaaaugu

SEQ ID NO: 990 - RNA, 21 nt, Artificial Sequence
  Synthetic oligonucleotide
caaguuagauaacaaaauguu

SEQ ID NO: 991 - RNA, 27 nt, Artificial Sequence
  Synthetic oligonucleotide
uacaucccaccaugaucaggaucaccc

SEQ ID NO: 992 - RNA, 27 nt, Artificial Sequence
  Synthetic oligonucleotide
gccagcuggcacaccaguccaacagca

SEQ ID NO: 993 - RNA, 27 nt, Artificial Sequence
  Synthetic oligonucleotide
cagcuggcacaccaguccaacagcacc

SEQ ID NO: 994 - RNA, 27 nt, Artificial Sequence
  Synthetic oligonucleotide
cuggcacaccaguccaacagcaccaau

SEQ ID NO: 995 - RNA, 27 nt, Artificial Sequence
  Synthetic oligonucleotide
uggcacaccaguccaacagcaccaaua

SEQ ID NO: 996 - RNA, 27 nt, Artificial Sequence
  Synthetic oligonucleotide
ggcacaccaguccaacagcaccaauau

SEQ ID NO: 997 - RNA, 27 nt, Artificial Sequence
  Synthetic oligonucleotide
gcacaccaguccaacagcaccaauauc

SEQ ID NO: 998 - RNA, 27 nt, Artificial Sequence
  Synthetic oligonucleotide
cacaccaguccaacagcaccaauaucu

SEQ ID NO: 999 - RNA, 27 nt, Artificial Sequence
  Synthetic oligonucleotide
caccaauaucuucuucuccccagugag

SEQ ID NO: 1000 - RNA, 27 nt, Artificial Sequence
  Synthetic oligonucleotide
accaauaucuucuucuccccagugagc

SEQ ID NO: 1001 - RNA, 27 nt, Artificial Sequence
  Synthetic oligonucleotide
ccaauaucuucuucuccccagugagca

SEQ ID NO: 1002 - RNA, 27 nt, Artificial Sequence
  Synthetic oligonucleotide
caauaucuucuucuccccagugagcau

SEQ ID NO: 1003 - RNA, 27 nt, Artificial Sequence
  Synthetic oligonucleotide
aauaucuucuucuccccagugagcauc

SEQ ID NO: 1004 - RNA, 27 nt, Artificial Sequence
  Synthetic oligonucleotide
auaucuucuucuccccagugagcaucg

SEQ ID NO: 1005 - RNA, 27 nt, Artificial Sequence
  Synthetic oligonucleotide
uaucuucuucuccccagugagcaucgc

SEQ ID NO: 1006 - RNA, 27 nt, Artificial Sequence
  Synthetic oligonucleotide
aucuucuucuccccagugagcaucgcu

SEQ ID NO: 1007 - RNA, 27 nt, Artificial Sequence
  Synthetic oligonucleotide
ucuucuucuccccagugagcaucgcua

SEQ ID NO: 1008 - RNA, 27 nt, Artificial Sequence
  Synthetic oligonucleotide
cuucuucuccccagugagcaucgcuac

SEQ ID NO: 1009 - RNA, 27 nt, Artificial Sequence
  Synthetic oligonucleotide
uucuucuccccagugagcaucgcuaca

SEQ ID NO: 1010 - RNA, 27 nt, Artificial Sequence
  Synthetic oligonucleotide
cuucuccccagugagcaucgcuacagc

SEQ ID NO: 1011 - RNA, 27 nt, Artificial Sequence
  Synthetic oligonucleotide
uucuccccagugagcaucgcuacagcc

SEQ ID NO: 1012 - RNA, 27 nt, Artificial Sequence
  Synthetic oligonucleotide
cuccccagugagcaucgcuacagccuu

SEQ ID NO: 1013 - RNA, 27 nt, Artificial Sequence
  Synthetic oligonucleotide
cuacagccuuugcaaugcucucccugg

SEQ ID NO: 1014 - RNA, 27 nt, Artificial Sequence
  Synthetic oligonucleotide
uuugcaaugcucucccuggggaccaag

SEQ ID NO: 1015 - RNA, 27 nt, Artificial Sequence
  Synthetic oligonucleotide
ugaaauccuggagggccugaauuucaa

SEQ ID NO: 1016 - RNA, 27 nt, Artificial Sequence
  Synthetic oligonucleotide
gaaauccuggagggccugaauuucaac

SEQ ID NO: 1017 - RNA, 27 nt, Artificial Sequence
  Synthetic oligonucleotide
aaauccuggagggccugaauuucaacc

SEQ ID NO: 1018 - RNA, 27 nt, Artificial Sequence
  Synthetic oligonucleotide
auccuggagggccugaauuucaaccuc

SEQ ID NO: 1019 - RNA, 27 nt, Artificial Sequence
  Synthetic oligonucleotide
uccuggagggccugaauuucaaccuca

SEQ ID NO: 1020 - RNA, 27 nt, Artificial Sequence
  Synthetic oligonucleotide
ccuggagggccugaauuucaaccucac

SEQ ID NO: 1021 - RNA, 27 nt, Artificial Sequence
  Synthetic oligonucleotide
uccaugaaggcuuccaggaacuccucc

SEQ ID NO: 1022 - RNA, 27 nt, Artificial Sequence
  Synthetic oligonucleotide
augaaggcuuccaggaacuccuccgua

SEQ ID NO: 1023 - RNA, 27 nt, Artificial Sequence
  Synthetic oligonucleotide
ugaaggcuuccaggaacuccuccguac

SEQ ID NO: 1024 - RNA, 27 nt, Artificial Sequence
  Synthetic oligonucleotide
ccagccagacagccagcuccagcugac

SEQ ID NO: 1025 - RNA, 27 nt, Artificial Sequence
  Synthetic oligonucleotide
agccagacagccagcuccagcugacca

SEQ ID NO: 1026 - RNA, 27 nt, Artificial Sequence
  Synthetic oligonucleotide
ccagacagccagcuccagcugaccacc

SEQ ID NO: 1027 - RNA, 27 nt, Artificial Sequence
  Synthetic oligonucleotide
cagacagccagcuccagcugaccaccg

SEQ ID NO: 1028 - RNA, 27 nt, Artificial Sequence
  Synthetic oligonucleotide
gcuaguggauaaguuuuuggaggaugu

SEQ ID NO: 1029 - RNA, 27 nt, Artificial Sequence
  Synthetic oligonucleotide
cuaguggauaaguuuuuggaggauguu

SEQ ID NO: 1030 - RNA, 27 nt, Artificial Sequence
  Synthetic oligonucleotide
uaguggauaaguuuuuggaggauguua

SEQ ID NO: 1031 - RNA, 27 nt, Artificial Sequence
  Synthetic oligonucleotide
aguggauaaguuuuuggaggauguuaa

SEQ ID NO: 1032 - RNA, 27 nt, Artificial Sequence
  Synthetic oligonucleotide
guggauaaguuuuuggaggauguuaaa

SEQ ID NO: 1033 - RNA, 27 nt, Artificial Sequence
  Synthetic oligonucleotide
uggauaaguuuuuggaggauguuaaaa

SEQ ID NO: 1034 - RNA, 27 nt, Artificial Sequence
  Synthetic oligonucleotide
ggauaaguuuuuggaggauguuaaaaa

SEQ ID NO: 1035 - RNA, 27 nt, Artificial Sequence
  Synthetic oligonucleotide
guuguaccacucagaagccuucacugu

SEQ ID NO: 1036 - RNA, 27 nt, Artificial Sequence
  Synthetic oligonucleotide
uuguaccacucagaagccuucacuguc

SEQ ID NO: 1037 - RNA, 27 nt, Artificial Sequence
  Synthetic oligonucleotide
guacucaagggaaaauuguggauuugg

SEQ ID NO: 1038 - RNA, 27 nt, Artificial Sequence
  Synthetic oligonucleotide
uacucaagggaaaauuguggauuuggu

SEQ ID NO: 1039 - RNA, 27 nt, Artificial Sequence
  Synthetic oligonucleotide
acucaagggaaaauuguggauuugguc

SEQ ID NO: 1040 - RNA, 27 nt, Artificial Sequence
  Synthetic oligonucleotide
cucaagggaaaauuguggauuugguca

SEQ ID NO: 1041 - RNA, 27 nt, Artificial Sequence
  Synthetic oligonucleotide
ucaagggaaaauuguggauuuggucaa

SEQ ID NO: 1042 - RNA, 27 nt, Artificial Sequence
  Synthetic oligonucleotide
caagggaaaauuguggauuuggucaag

SEQ ID NO: 1043 - RNA, 27 nt, Artificial Sequence
  Synthetic oligonucleotide
aagggaaaauuguggauuuggucaagg

SEQ ID NO: 1044 - RNA, 27 nt, Artificial Sequence
  Synthetic oligonucleotide
agggaaaauuguggauuuggucaagga

SEQ ID NO: 1045 - RNA, 27 nt, Artificial Sequence
  Synthetic oligonucleotide
gggaaaauuguggauuuggucaaggag

SEQ ID NO: 1046 - RNA, 27 nt, Artificial Sequence
  Synthetic oligonucleotide
ggaaaauuguggauuuggucaaggagc

SEQ ID NO: 1047 - RNA, 27 nt, Artificial Sequence
  Synthetic oligonucleotide
gaaaauuguggauuuggucaaggagcu

SEQ ID NO: 1048 - RNA, 27 nt, Artificial Sequence
  Synthetic oligonucleotide
aaaauuguggauuuggucaaggagcuu

SEQ ID NO: 1049 - RNA, 27 nt, Artificial Sequence
  Synthetic oligonucleotide
aaauuguggauuuggucaaggagcuug

SEQ ID NO: 1050 - RNA, 27 nt, Artificial Sequence
  Synthetic oligonucleotide
aauuguggauuuggucaaggagcuuga

SEQ ID NO: 1051 - RNA, 27 nt, Artificial Sequence
  Synthetic oligonucleotide
auuguggauuuggucaaggagcuugac

SEQ ID NO: 1052 - RNA, 27 nt, Artificial Sequence
  Synthetic oligonucleotide
uuguggauuuggucaaggagcuugaca

SEQ ID NO: 1053 - RNA, 27 nt, Artificial Sequence
  Synthetic oligonucleotide
uguggauuuggucaaggagcuugacag

SEQ ID NO: 1054 - RNA, 27 nt, Artificial Sequence
  Synthetic oligonucleotide
guggauuuggucaaggagcuugacaga

SEQ ID NO: 1055 - RNA, 27 nt, Artificial Sequence
  Synthetic oligonucleotide
uggauuuggucaaggagcuugacagag

SEQ ID NO: 1056 - RNA, 27 nt, Artificial Sequence
  Synthetic oligonucleotide
ggauuuggucaaggagcuugacagaga

SEQ ID NO: 1057 - RNA, 27 nt, Artificial Sequence
  Synthetic oligonucleotide
gauuuggucaaggagcuugacagagac

SEQ ID NO: 1058 - RNA, 27 nt, Artificial Sequence
  Synthetic oligonucleotide
auuuggucaaggagcuugacagagaca

SEQ ID NO: 1059 - RNA, 27 nt, Artificial Sequence
  Synthetic oligonucleotide
uuuggucaaggagcuugacagagacac

SEQ ID NO: 1060 - RNA, 27 nt, Artificial Sequence
  Synthetic oligonucleotide
cacaguuuuugcucuggugaauuacau

SEQ ID NO: 1061 - RNA, 27 nt, Artificial Sequence
  Synthetic oligonucleotide
acaguuuuugcucuggugaauuacauc

SEQ ID NO: 1062 - RNA, 27 nt, Artificial Sequence
  Synthetic oligonucleotide
caguuuuugcucuggugaauuacaucu

SEQ ID NO: 1063 - RNA, 27 nt, Artificial Sequence
  Synthetic oligonucleotide
aguuuuugcucuggugaauuacaucuu

SEQ ID NO: 1064 - RNA, 27 nt, Artificial Sequence
  Synthetic oligonucleotide
uuaaaggcaaaugggagagacccuuug

SEQ ID NO: 1065 - RNA, 27 nt, Artificial Sequence
  Synthetic oligonucleotide
uaaaggcaaaugggagagacccuuuga

SEQ ID NO: 1066 - RNA, 27 nt, Artificial Sequence
  Synthetic oligonucleotide
aaaggcaaaugggagagacccuuugaa

SEQ ID NO: 1067 - RNA, 27 nt, Artificial Sequence
  Synthetic oligonucleotide
aaggcaaaugggagagacccuuugaag

SEQ ID NO: 1068 - RNA, 27 nt, Artificial Sequence
  Synthetic oligonucleotide
cgaggaagaggacuuccacguggacca

SEQ ID NO: 1069 - RNA, 27 nt, Artificial Sequence
  Synthetic oligonucleotide
gaggaagaggacuuccacguggaccag

SEQ ID NO: 1070 - RNA, 27 nt, Artificial Sequence
  Synthetic oligonucleotide
aggaagaggacuuccacguggaccagg

SEQ ID NO: 1071 - RNA, 27 nt, Artificial Sequence
  Synthetic oligonucleotide
ggaagaggacuuccacguggaccaggu

SEQ ID NO: 1072 - RNA, 27 nt, Artificial Sequence
  Synthetic oligonucleotide
aagaggacuuccacguggaccagguga

SEQ ID NO: 1073 - RNA, 27 nt, Artificial Sequence
  Synthetic oligonucleotide
agaggacuuccacguggaccaggugac

SEQ ID NO: 1074 - RNA, 27 nt, Artificial Sequence
  Synthetic oligonucleotide
aggacuuccacguggaccaggugacca

SEQ ID NO: 1075 - RNA, 27 nt, Artificial Sequence
  Synthetic oligonucleotide
gcguuuaggcauguuuaacauccagca

SEQ ID NO: 1076 - RNA, 27 nt, Artificial Sequence
  Synthetic oligonucleotide
cguuuaggcauguuuaacauccagcac

SEQ ID NO: 1077 - RNA, 27 nt, Artificial Sequence
  Synthetic oligonucleotide
aagcuguccagcugggugcugcugaug

SEQ ID NO: 1078 - RNA, 27 nt, Artificial Sequence
  Synthetic oligonucleotide
agcuguccagcugggugcugcugauga

SEQ ID NO: 1079 - RNA, 27 nt, Artificial Sequence
  Synthetic oligonucleotide
ggcaaugccaccgccaucuucuuccug

SEQ ID NO: 1080 - RNA, 27 nt, Artificial Sequence
  Synthetic oligonucleotide
gcaaugccaccgccaucuucuuccugc

SEQ ID NO: 1081 - RNA, 27 nt, Artificial Sequence
  Synthetic oligonucleotide
ugccaccgccaucuucuuccugccuga

SEQ ID NO: 1082 - RNA, 27 nt, Artificial Sequence
  Synthetic oligonucleotide
gccaccgccaucuucuuccugccugau

SEQ ID NO: 1083 - RNA, 27 nt, Artificial Sequence
  Synthetic oligonucleotide
ccaccgccaucuucuuccugccugaug

SEQ ID NO: 1084 - RNA, 27 nt, Artificial Sequence
  Synthetic oligonucleotide
caccgccaucuucuuccugccugauga

SEQ ID NO: 1085 - RNA, 27 nt, Artificial Sequence
  Synthetic oligonucleotide
accgccaucuucuuccugccugaugag

SEQ ID NO: 1086 - RNA, 27 nt, Artificial Sequence
  Synthetic oligonucleotide
ccgccaucuucuuccugccugaugagg

SEQ ID NO: 1087 - RNA, 27 nt, Artificial Sequence
  Synthetic oligonucleotide
ccaucuucuuccugccugaugagggga

SEQ ID NO: 1088 - RNA, 27 nt, Artificial Sequence
  Synthetic oligonucleotide
uucuuccugccugaugaggggaaacua

SEQ ID NO: 1089 - RNA, 27 nt, Artificial Sequence
  Synthetic oligonucleotide
ucuuccugccugaugaggggaaacuac

SEQ ID NO: 1090 - RNA, 27 nt, Artificial Sequence
  Synthetic oligonucleotide
cuuccugccugaugaggggaaacuaca

SEQ ID NO: 1091 - RNA, 27 nt, Artificial Sequence
  Synthetic oligonucleotide
uuccugccugaugaggggaaacuacag

SEQ ID NO: 1092 - RNA, 27 nt, Artificial Sequence
  Synthetic oligonucleotide
uccugccugaugaggggaaacuacagc

SEQ ID NO: 1093 - RNA, 27 nt, Artificial Sequence
  Synthetic oligonucleotide
ccugccugaugaggggaaacuacagca

SEQ ID NO: 1094 - RNA, 27 nt, Artificial Sequence
  Synthetic oligonucleotide
acagcaccuggaaaaugaacucaccca

SEQ ID NO: 1095 - RNA, 27 nt, Artificial Sequence
  Synthetic oligonucleotide
cagcaccuggaaaaugaacucacccac

SEQ ID NO: 1096 - RNA, 27 nt, Artificial Sequence
  Synthetic oligonucleotide
agcaccuggaaaaugaacucacccacg

SEQ ID NO: 1097 - RNA, 27 nt, Artificial Sequence
  Synthetic oligonucleotide
gcaccuggaaaaugaacucacccacga

SEQ ID NO: 1098 - RNA, 27 nt, Artificial Sequence
  Synthetic oligonucleotide
caccuggaaaaugaacucacccacgau

SEQ ID NO: 1099 - RNA, 27 nt, Artificial Sequence
  Synthetic oligonucleotide
cgauaucaucaccaaguuccuggaaaa

SEQ ID NO: 1100 - RNA, 27 nt, Artificial Sequence
  Synthetic oligonucleotide
gauaucaucaccaaguuccuggaaaau

SEQ ID NO: 1101 - RNA, 27 nt, Artificial Sequence
  Synthetic oligonucleotide
auaucaucaccaaguuccuggaaaaug

SEQ ID NO: 1102 - RNA, 27 nt, Artificial Sequence
  Synthetic oligonucleotide
uaucaucaccaaguuccuggaaaauga

SEQ ID NO: 1103 - RNA, 27 nt, Artificial Sequence
  Synthetic oligonucleotide
aucaucaccaaguuccuggaaaaugaa

SEQ ID NO: 1104 - RNA, 27 nt, Artificial Sequence
  Synthetic oligonucleotide
ucaucaccaaguuccuggaaaaugaag

SEQ ID NO: 1105 - RNA, 27 nt, Artificial Sequence
  Synthetic oligonucleotide
caucaccaaguuccuggaaaaugaaga

SEQ ID NO: 1106 - RNA, 27 nt, Artificial Sequence
  Synthetic oligonucleotide
aucaccaaguuccuggaaaaugaagac

SEQ ID NO: 1107 - RNA, 27 nt, Artificial Sequence
  Synthetic oligonucleotide
ucaccaaguuccuggaaaaugaagaca

SEQ ID NO: 1108 - RNA, 27 nt, Artificial Sequence
  Synthetic oligonucleotide
caccaaguuccuggaaaaugaagacag

SEQ ID NO: 1109 - RNA, 27 nt, Artificial Sequence
  Synthetic oligonucleotide
uaaggucuucagcaauggggcugaccu

SEQ ID NO: 1110 - RNA, 27 nt, Artificial Sequence
  Synthetic oligonucleotide
agcaauggggcugaccucuccgggguc

SEQ ID NO: 1111 - RNA, 27 nt, Artificial Sequence
  Synthetic oligonucleotide
gcaauggggcugaccucuccgggguca

SEQ ID NO: 1112 - RNA, 27 nt, Artificial Sequence
  Synthetic oligonucleotide
caauggggcugaccucuccggggucac

SEQ ID NO: 1113 - RNA, 27 nt, Artificial Sequence
  Synthetic oligonucleotide
cagaggaggcaccccugaagcucucca

SEQ ID NO: 1114 - RNA, 27 nt, Artificial Sequence
  Synthetic oligonucleotide
gaggaggcaccccugaagcucuccaag

SEQ ID NO: 1115 - RNA, 27 nt, Artificial Sequence
  Synthetic oligonucleotide
cccugaagcucuccaaggccgugcaua

SEQ ID NO: 1116 - RNA, 27 nt, Artificial Sequence
  Synthetic oligonucleotide
gccgugcauaaggcugugcugaccauc

SEQ ID NO: 1117 - RNA, 27 nt, Artificial Sequence
  Synthetic oligonucleotide
ccgugcauaaggcugugcugaccaucg

SEQ ID NO: 1118 - RNA, 27 nt, Artificial Sequence
  Synthetic oligonucleotide
cgugcauaaggcugugcugaccaucga

SEQ ID NO: 1119 - RNA, 27 nt, Artificial Sequence
  Synthetic oligonucleotide
gugcauaaggcugugcugaccaucgac

SEQ ID NO: 1120 - RNA, 27 nt, Artificial Sequence
  Synthetic oligonucleotide
ugcauaaggcugugcugaccaucgacg

SEQ ID NO: 1121 - RNA, 27 nt, Artificial Sequence
  Synthetic oligonucleotide
gcauaaggcugugcugaccaucgacga

SEQ ID NO: 1122 - RNA, 27 nt, Artificial Sequence
  Synthetic oligonucleotide
cauaaggcugugcugaccaucgacgag

SEQ ID NO: 1123 - RNA, 27 nt, Artificial Sequence
  Synthetic oligonucleotide
auaaggcugugcugaccaucgacgaga

SEQ ID NO: 1124 - RNA, 27 nt, Artificial Sequence
  Synthetic oligonucleotide
uaaggcugugcugaccaucgacgagaa

SEQ ID NO: 1125 - RNA, 27 nt, Artificial Sequence
  Synthetic oligonucleotide
ggacugaagcugcuggggccauguuuu

SEQ ID NO: 1126 - RNA, 27 nt, Artificial Sequence
  Synthetic oligonucleotide
gacugaagcugcuggggccauguuuuu

SEQ ID NO: 1127 - RNA, 27 nt, Artificial Sequence
  Synthetic oligonucleotide
acugaagcugcuggggccauguuuuua

SEQ ID NO: 1128 - RNA, 27 nt, Artificial Sequence
  Synthetic oligonucleotide
cugaagcugcuggggccauguuuuuag

SEQ ID NO: 1129 - RNA, 27 nt, Artificial Sequence
  Synthetic oligonucleotide
ugaagcugcuggggccauguuuuuaga

SEQ ID NO: 1130 - RNA, 27 nt, Artificial Sequence
  Synthetic oligonucleotide
gaagcugcuggggccauguuuuuagag

SEQ ID NO: 1131 - RNA, 27 nt, Artificial Sequence
  Synthetic oligonucleotide
gggccauguuuuuagaggccauaccca

SEQ ID NO: 1132 - RNA, 27 nt, Artificial Sequence
  Synthetic oligonucleotide
ggccauguuuuuagaggccauacccau

SEQ ID NO: 1133 - RNA, 27 nt, Artificial Sequence
  Synthetic oligonucleotide
gccauguuuuuagaggccauacccaug

SEQ ID NO: 1134 - RNA, 27 nt, Artificial Sequence
  Synthetic oligonucleotide
ccauguuuuuagaggccauacccaugu

SEQ ID NO: 1135 - RNA, 27 nt, Artificial Sequence
  Synthetic oligonucleotide
cauguuuuuagaggccauacccauguc

SEQ ID NO: 1136 - RNA, 27 nt, Artificial Sequence
  Synthetic oligonucleotide
auguuuuuagaggccauacccaugucu

SEQ ID NO: 1137 - RNA, 27 nt, Artificial Sequence
  Synthetic oligonucleotide
uguuuuuagaggccauacccaugucua

SEQ ID NO: 1138 - RNA, 27 nt, Artificial Sequence
  Synthetic oligonucleotide
guuuuuagaggccauacccaugucuau

SEQ ID NO: 1139 - RNA, 27 nt, Artificial Sequence
  Synthetic oligonucleotide
uuuuuagaggccauacccaugucuauc

SEQ ID NO: 1140 - RNA, 27 nt, Artificial Sequence
  Synthetic oligonucleotide
uuuuagaggccauacccaugucuaucc

SEQ ID NO: 1141 - RNA, 27 nt, Artificial Sequence
  Synthetic oligonucleotide
uuuagaggccauacccaugucuauccc

SEQ ID NO: 1142 - RNA, 27 nt, Artificial Sequence
  Synthetic oligonucleotide
uuagaggccauacccaugucuaucccc

SEQ ID NO: 1143 - RNA, 27 nt, Artificial Sequence
  Synthetic oligonucleotide
aaguucaacaaacccuuugucuucuua

SEQ ID NO: 1144 - RNA, 27 nt, Artificial Sequence
  Synthetic oligonucleotide
aguucaacaaacccuuugucuucuuaa

SEQ ID NO: 1145 - RNA, 27 nt, Artificial Sequence
  Synthetic oligonucleotide
guucaacaaacccuuugucuucuuaau

SEQ ID NO: 1146 - RNA, 27 nt, Artificial Sequence
  Synthetic oligonucleotide
uucaacaaacccuuugucuucuuaaug

SEQ ID NO: 1147 - RNA, 27 nt, Artificial Sequence
  Synthetic oligonucleotide
ucaacaaacccuuugucuucuuaauga

SEQ ID NO: 1148 - RNA, 27 nt, Artificial Sequence
  Synthetic oligonucleotide
caacaaacccuuugucuucuuaaugau

SEQ ID NO: 1149 - RNA, 27 nt, Artificial Sequence
  Synthetic oligonucleotide
aacaaacccuuugucuucuuaaugauu

SEQ ID NO: 1150 - RNA, 27 nt, Artificial Sequence
  Synthetic oligonucleotide
acaaacccuuugucuucuuaaugauug

SEQ ID NO: 1151 - RNA, 27 nt, Artificial Sequence
  Synthetic oligonucleotide
caaacccuuugucuucuuaaugauuga

SEQ ID NO: 1152 - RNA, 27 nt, Artificial Sequence
  Synthetic oligonucleotide
aaaauaccaagucuccccucuucaugg

SEQ ID NO: 1153 - RNA, 27 nt, Artificial Sequence
  Synthetic oligonucleotide
aaauaccaagucuccccucuucauggg

SEQ ID NO: 1154 - RNA, 27 nt, Artificial Sequence
  Synthetic oligonucleotide
aauaccaagucuccccucuucauggga

SEQ ID NO: 1155 - RNA, 27 nt, Artificial Sequence
  Synthetic oligonucleotide
auaccaagucuccccucuucaugggaa

SEQ ID NO: 1156 - RNA, 27 nt, Artificial Sequence
  Synthetic oligonucleotide
uaccaagucuccccucuucaugggaaa

SEQ ID NO: 1157 - RNA, 27 nt, Artificial Sequence
  Synthetic oligonucleotide
accaagucuccccucuucaugggaaaa

SEQ ID NO: 1158 - RNA, 27 nt, Artificial Sequence
  Synthetic oligonucleotide
ccaagucuccccucuucaugggaaaag

SEQ ID NO: 1159 - RNA, 27 nt, Artificial Sequence
  Synthetic oligonucleotide
caagucuccccucuucaugggaaaagu

SEQ ID NO: 1160 - RNA, 27 nt, Artificial Sequence
  Synthetic oligonucleotide
aagucuccccucuucaugggaaaagug

SEQ ID NO: 1161 - RNA, 27 nt, Artificial Sequence
  Synthetic oligonucleotide
gucuccccucuucaugggaaaaguggu

SEQ ID NO: 1162 - RNA, 27 nt, Artificial Sequence
  Synthetic oligonucleotide
cuccccucuucaugggaaaagugguga

SEQ ID NO: 1163 - RNA, 27 nt, Artificial Sequence
  Synthetic oligonucleotide
uccccucuucaugggaaaaguggugaa

SEQ ID NO: 1164 - RNA, 27 nt, Artificial Sequence
  Synthetic oligonucleotide
ccccucuucaugggaaaaguggugaau

SEQ ID NO: 1165 - RNA, 27 nt, Artificial Sequence
  Synthetic oligonucleotide
cccucuucaugggaaaaguggugaauc

SEQ ID NO: 1166 - RNA, 27 nt, Artificial Sequence
  Synthetic oligonucleotide
ccucuucaugggaaaaguggugaaucc

SEQ ID NO: 1167 - RNA, 27 nt, Artificial Sequence
  Synthetic oligonucleotide
cucuucaugggaaaaguggugaauccc

SEQ ID NO: 1168 - RNA, 27 nt, Artificial Sequence
  Synthetic oligonucleotide
ucuucaugggaaaaguggugaauccca

SEQ ID NO: 1169 - RNA, 27 nt, Artificial Sequence
  Synthetic oligonucleotide
cuucaugggaaaaguggugaaucccac

SEQ ID NO: 1170 - RNA, 27 nt, Artificial Sequence
  Synthetic oligonucleotide
uucaugggaaaaguggugaaucccacc

SEQ ID NO: 1171 - RNA, 27 nt, Artificial Sequence
  Synthetic oligonucleotide
ucaugggaaaaguggugaaucccaccc

SEQ ID NO: 1172 - RNA, 27 nt, Artificial Sequence
  Synthetic oligonucleotide
caugggaaaaguggugaaucccaccca

SEQ ID NO: 1173 - RNA, 27 nt, Artificial Sequence
  Synthetic oligonucleotide
augggaaaaguggugaaucccacccaa

SEQ ID NO: 1174 - RNA, 27 nt, Artificial Sequence
  Synthetic oligonucleotide
ugggaaaaguggugaaucccacccaaa

SEQ ID NO: 1175 - RNA, 27 nt, Artificial Sequence
  Synthetic oligonucleotide
gggaaaaguggugaaucccacccaaaa

SEQ ID NO: 1176 - RNA, 27 nt, Artificial Sequence
  Synthetic oligonucleotide
ggaaaaguggugaaucccacccaaaaa

SEQ ID NO: 1177 - RNA, 27 nt, Artificial Sequence
  Synthetic oligonucleotide
gaaaaguggugaaucccacccaaaaau

SEQ ID NO: 1178 - RNA, 27 nt, Artificial Sequence
  Synthetic oligonucleotide
aaaaguggugaaucccacccaaaaaua

SEQ ID NO: 1179 - RNA, 27 nt, Artificial Sequence
  Synthetic oligonucleotide
uucgauaguucaaaauggugaaauuag

SEQ ID NO: 1180 - RNA, 27 nt, Artificial Sequence
  Synthetic oligonucleotide
uucaaaauggugaaauuagcaauucua

SEQ ID NO: 1181 - RNA, 27 nt, Artificial Sequence
  Synthetic oligonucleotide
aguugguaugauguucaaguuagauaa

SEQ ID NO: 1182 - RNA, 27 nt, Artificial Sequence
  Synthetic oligonucleotide
uugguaugauguucaaguuagauaaca

SEQ ID NO: 1183 - RNA, 27 nt, Artificial Sequence
  Synthetic oligonucleotide
ugguaugauguucaaguuagauaacaa

SEQ ID NO: 1184 - RNA, 27 nt, Artificial Sequence
  Synthetic oligonucleotide
guaugauguucaaguuagauaacaaaa

SEQ ID NO: 1185 - RNA, 27 nt, Artificial Sequence
  Synthetic oligonucleotide
ugauguucaaguuagauaacaaaaugu

SEQ ID NO: 1186 - RNA, 27 nt, Artificial Sequence
  Synthetic oligonucleotide
uucaaguuagauaacaaaauguuuaua

SEQ ID NO: 1187 - RNA, 27 nt, Artificial Sequence
  Synthetic oligonucleotide
ucaaguuagauaacaaaauguuuauac

SEQ ID NO: 1188 - RNA, 27 nt, Artificial Sequence
  Synthetic oligonucleotide
caaguuagauaacaaaauguuuauacc

SEQ ID NO: 1189 - RNA, 19 nt, Artificial Sequence
  Synthetic oligonucleotide
caucccaccaugaucagga

SEQ ID NO: 1190 - RNA, 19 nt, Artificial Sequence
  Synthetic oligonucleotide
cagcuggcacaccagucca

SEQ ID NO: 1191 - RNA, 19 nt, Artificial Sequence
  Synthetic oligonucleotide
gcuggcacaccaguccaac

SEQ ID NO: 1192 - RNA, 19 nt, Artificial Sequence
  Synthetic oligonucleotide
ggcacaccaguccaacagc

SEQ ID NO: 1193 - RNA, 19 nt, Artificial Sequence
  Synthetic oligonucleotide
gcacaccaguccaacagca

SEQ ID NO: 1194 - RNA, 19 nt, Artificial Sequence
  Synthetic oligonucleotide
cacaccaguccaacagcac

SEQ ID NO: 1195 - RNA, 19 nt, Artificial Sequence
  Synthetic oligonucleotide
acaccaguccaacagcacc

SEQ ID NO: 1196 - RNA, 19 nt, Artificial Sequence
  Synthetic oligonucleotide
caccaguccaacagcacca

SEQ ID NO: 1197 - RNA, 19 nt, Artificial Sequence
  Synthetic oligonucleotide
ccaauaucuucuucucccc

SEQ ID NO: 1198 - RNA, 19 nt, Artificial Sequence
  Synthetic oligonucleotide
caauaucuucuucucccca

SEQ ID NO: 1199 - RNA, 19 nt, Artificial Sequence
  Synthetic oligonucleotide
aauaucuucuucuccccag

SEQ ID NO: 1200 - RNA, 19 nt, Artificial Sequence
  Synthetic oligonucleotide
auaucuucuucuccccagu

SEQ ID NO: 1201 - RNA, 19 nt, Artificial Sequence
  Synthetic oligonucleotide
uaucuucuucuccccagug

SEQ ID NO: 1202 - RNA, 19 nt, Artificial Sequence
  Synthetic oligonucleotide
aucuucuucuccccaguga

SEQ ID NO: 1203 - RNA, 19 nt, Artificial Sequence
  Synthetic oligonucleotide
ucuucuucuccccagugag

SEQ ID NO: 1204 - RNA, 19 nt, Artificial Sequence
  Synthetic oligonucleotide
cuucuucuccccagugagc

SEQ ID NO: 1205 - RNA, 19 nt, Artificial Sequence
  Synthetic oligonucleotide
uucuucuccccagugagca

SEQ ID NO: 1206 - RNA, 19 nt, Artificial Sequence
  Synthetic oligonucleotide
ucuucuccccagugagcau

SEQ ID NO: 1207 - RNA, 19 nt, Artificial Sequence
  Synthetic oligonucleotide
cuucuccccagugagcauc

SEQ ID NO: 1208 - RNA, 19 nt, Artificial Sequence
  Synthetic oligonucleotide
ucuccccagugagcaucgc

SEQ ID NO: 1209 - RNA, 19 nt, Artificial Sequence
  Synthetic oligonucleotide
cuccccagugagcaucgcu

SEQ ID NO: 1210 - RNA, 19 nt, Artificial Sequence
  Synthetic oligonucleotide
ccccagugagcaucgcuac

SEQ ID NO: 1211 - RNA, 19 nt, Artificial Sequence
  Synthetic oligonucleotide
acagccuuugcaaugcucu

SEQ ID NO: 1212 - RNA, 19 nt, Artificial Sequence
  Synthetic oligonucleotide
ugcaaugcucucccugggg

SEQ ID NO: 1213 - RNA, 19 nt, Artificial Sequence
  Synthetic oligonucleotide
aaauccuggagggccugaa

SEQ ID NO: 1214 - RNA, 19 nt, Artificial Sequence
  Synthetic oligonucleotide
aauccuggagggccugaau

SEQ ID NO: 1215 - RNA, 19 nt, Artificial Sequence
  Synthetic oligonucleotide
auccuggagggccugaauu

SEQ ID NO: 1216 - RNA, 19 nt, Artificial Sequence
  Synthetic oligonucleotide
ccuggagggccugaauuuc

SEQ ID NO: 1217 - RNA, 19 nt, Artificial Sequence
  Synthetic oligonucleotide
cuggagggccugaauuuca

SEQ ID NO: 1218 - RNA, 19 nt, Artificial Sequence
  Synthetic oligonucleotide
uggagggccugaauuucaa

SEQ ID NO: 1219 - RNA, 19 nt, Artificial Sequence
  Synthetic oligonucleotide
caugaaggcuuccaggaac

SEQ ID NO: 1220 - RNA, 19 nt, Artificial Sequence
  Synthetic oligonucleotide
gaaggcuuccaggaacucc

SEQ ID NO: 1221 - RNA, 19 nt, Artificial Sequence
  Synthetic oligonucleotide
aaggcuuccaggaacuccu

SEQ ID NO: 1222 - RNA, 19 nt, Artificial Sequence
  Synthetic oligonucleotide
agccagacagccagcucca

SEQ ID NO: 1223 - RNA, 19 nt, Artificial Sequence
  Synthetic oligonucleotide
ccagacagccagcuccagc

SEQ ID NO: 1224 - RNA, 19 nt, Artificial Sequence
  Synthetic oligonucleotide
agacagccagcuccagcug

SEQ ID NO: 1225 - RNA, 19 nt, Artificial Sequence
  Synthetic oligonucleotide
gacagccagcuccagcuga

SEQ ID NO: 1226 - RNA, 19 nt, Artificial Sequence
  Synthetic oligonucleotide
uaguggauaaguuuuugga

SEQ ID NO: 1227 - RNA, 19 nt, Artificial Sequence
  Synthetic oligonucleotide
aguggauaaguuuuuggag

SEQ ID NO: 1228 - RNA, 19 nt, Artificial Sequence
  Synthetic oligonucleotide
guggauaaguuuuuggagg

SEQ ID NO: 1229 - RNA, 19 nt, Artificial Sequence
  Synthetic oligonucleotide
uggauaaguuuuuggagga

SEQ ID NO: 1230 - RNA, 19 nt, Artificial Sequence
  Synthetic oligonucleotide
ggauaaguuuuuggaggau

SEQ ID NO: 1231 - RNA, 19 nt, Artificial Sequence
  Synthetic oligonucleotide
gauaaguuuuuggaggaug

SEQ ID NO: 1232 - RNA, 19 nt, Artificial Sequence
  Synthetic oligonucleotide
auaaguuuuuggaggaugu

SEQ ID NO: 1233 - RNA, 19 nt, Artificial Sequence
  Synthetic oligonucleotide
uguaccacucagaagccuu

SEQ ID NO: 1234 - RNA, 19 nt, Artificial Sequence
  Synthetic oligonucleotide
guaccacucagaagccuuc

SEQ ID NO: 1235 - RNA, 19 nt, Artificial Sequence
  Synthetic oligonucleotide
acucaagggaaaauugugg

SEQ ID NO: 1236 - RNA, 19 nt, Artificial Sequence
  Synthetic oligonucleotide
cucaagggaaaauugugga

SEQ ID NO: 1237 - RNA, 19 nt, Artificial Sequence
  Synthetic oligonucleotide
ucaagggaaaauuguggau

SEQ ID NO: 1238 - RNA, 19 nt, Artificial Sequence
  Synthetic oligonucleotide
caagggaaaauuguggauu

SEQ ID NO: 1239 - RNA, 19 nt, Artificial Sequence
  Synthetic oligonucleotide
aagggaaaauuguggauuu

SEQ ID NO: 1240 - RNA, 19 nt, Artificial Sequence
  Synthetic oligonucleotide
agggaaaauuguggauuug

SEQ ID NO: 1241 - RNA, 19 nt, Artificial Sequence
  Synthetic oligonucleotide
gggaaaauuguggauuugg

SEQ ID NO: 1242 - RNA, 19 nt, Artificial Sequence
  Synthetic oligonucleotide
ggaaaauuguggauuuggu

SEQ ID NO: 1243 - RNA, 19 nt, Artificial Sequence
  Synthetic oligonucleotide
gaaaauuguggauuugguc

SEQ ID NO: 1244 - RNA, 19 nt, Artificial Sequence
  Synthetic oligonucleotide
aaaauuguggauuugguca

SEQ ID NO: 1245 - RNA, 19 nt, Artificial Sequence
  Synthetic oligonucleotide
aaauuguggauuuggucaa

SEQ ID NO: 1246 - RNA, 19 nt, Artificial Sequence
  Synthetic oligonucleotide
aauuguggauuuggucaag

SEQ ID NO: 1247 - RNA, 19 nt, Artificial Sequence
  Synthetic oligonucleotide
auuguggauuuggucaagg

SEQ ID NO: 1248 - RNA, 19 nt, Artificial Sequence
  Synthetic oligonucleotide
uuguggauuuggucaagga

SEQ ID NO: 1249 - RNA, 19 nt, Artificial Sequence
  Synthetic oligonucleotide
uguggauuuggucaaggag

SEQ ID NO: 1250 - RNA, 19 nt, Artificial Sequence
  Synthetic oligonucleotide
guggauuuggucaaggagc

SEQ ID NO: 1251 - RNA, 19 nt, Artificial Sequence
  Synthetic oligonucleotide
uggauuuggucaaggagcu

SEQ ID NO: 1252 - RNA, 19 nt, Artificial Sequence
  Synthetic oligonucleotide
ggauuuggucaaggagcuu

SEQ ID NO: 1253 - RNA, 19 nt, Artificial Sequence
  Synthetic oligonucleotide
gauuuggucaaggagcuug

SEQ ID NO: 1254 - RNA, 19 nt, Artificial Sequence
  Synthetic oligonucleotide
auuuggucaaggagcuuga

SEQ ID NO: 1255 - RNA, 19 nt, Artificial Sequence
  Synthetic oligonucleotide
uuuggucaaggagcuugac

SEQ ID NO: 1256 - RNA, 19 nt, Artificial Sequence
  Synthetic oligonucleotide
uuggucaaggagcuugaca

SEQ ID NO: 1257 - RNA, 19 nt, Artificial Sequence
  Synthetic oligonucleotide
uggucaaggagcuugacag

SEQ ID NO: 1258 - RNA, 19 nt, Artificial Sequence
  Synthetic oligonucleotide
caguuuuugcucuggugaa

SEQ ID NO: 1259 - RNA, 19 nt, Artificial Sequence
  Synthetic oligonucleotide
aguuuuugcucuggugaau

SEQ ID NO: 1260 - RNA, 19 nt, Artificial Sequence
  Synthetic oligonucleotide
guuuuugcucuggugaauu

SEQ ID NO: 1261 - RNA, 19 nt, Artificial Sequence
  Synthetic oligonucleotide
uuuuugcucuggugaauua

SEQ ID NO: 1262 - RNA, 19 nt, Artificial Sequence
  Synthetic oligonucleotide
aaaggcaaaugggagagac

SEQ ID NO: 1263 - RNA, 19 nt, Artificial Sequence
  Synthetic oligonucleotide
aaggcaaaugggagagacc

SEQ ID NO: 1264 - RNA, 19 nt, Artificial Sequence
  Synthetic oligonucleotide
aggcaaaugggagagaccc

SEQ ID NO: 1265 - RNA, 19 nt, Artificial Sequence
  Synthetic oligonucleotide
ggcaaaugggagagacccu

SEQ ID NO: 1266 - RNA, 19 nt, Artificial Sequence
  Synthetic oligonucleotide
aggaagaggacuuccacgu

SEQ ID NO: 1267 - RNA, 19 nt, Artificial Sequence
  Synthetic oligonucleotide
ggaagaggacuuccacgug

SEQ ID NO: 1268 - RNA, 19 nt, Artificial Sequence
  Synthetic oligonucleotide
gaagaggacuuccacgugg

SEQ ID NO: 1269 - RNA, 19 nt, Artificial Sequence
  Synthetic oligonucleotide
aagaggacuuccacgugga

SEQ ID NO: 1270 - RNA, 19 nt, Artificial Sequence
  Synthetic oligonucleotide
gaggacuuccacguggacc

SEQ ID NO: 1271 - RNA, 19 nt, Artificial Sequence
  Synthetic oligonucleotide
aggacuuccacguggacca

SEQ ID NO: 1272 - RNA, 19 nt, Artificial Sequence
  Synthetic oligonucleotide
gacuuccacguggaccagg

SEQ ID NO: 1273 - RNA, 19 nt, Artificial Sequence
  Synthetic oligonucleotide
guuuaggcauguuuaacau

SEQ ID NO: 1274 - RNA, 19 nt, Artificial Sequence
  Synthetic oligonucleotide
uuuaggcauguuuaacauc

SEQ ID NO: 1275 - RNA, 19 nt, Artificial Sequence
  Synthetic oligonucleotide
gcuguccagcugggugcug

SEQ ID NO: 1276 - RNA, 19 nt, Artificial Sequence
  Synthetic oligonucleotide
cuguccagcugggugcugc

SEQ ID NO: 1277 - RNA, 19 nt, Artificial Sequence
  Synthetic oligonucleotide
caaugccaccgccaucuuc

SEQ ID NO: 1278 - RNA, 19 nt, Artificial Sequence
  Synthetic oligonucleotide
aaugccaccgccaucuucu

SEQ ID NO: 1279 - RNA, 19 nt, Artificial Sequence
  Synthetic oligonucleotide
ccaccgccaucuucuuccu

SEQ ID NO: 1280 - RNA, 19 nt, Artificial Sequence
  Synthetic oligonucleotide
caccgccaucuucuuccug

SEQ ID NO: 1281 - RNA, 19 nt, Artificial Sequence
  Synthetic oligonucleotide
accgccaucuucuuccugc

SEQ ID NO: 1282 - RNA, 19 nt, Artificial Sequence
  Synthetic oligonucleotide
ccgccaucuucuuccugcc

SEQ ID NO: 1283 - RNA, 19 nt, Artificial Sequence
  Synthetic oligonucleotide
cgccaucuucuuccugccu

SEQ ID NO: 1284 - RNA, 19 nt, Artificial Sequence
  Synthetic oligonucleotide
gccaucuucuuccugccug

SEQ ID NO: 1285 - RNA, 19 nt, Artificial Sequence
  Synthetic oligonucleotide
aucuucuuccugccugaug

SEQ ID NO: 1286 - RNA, 19 nt, Artificial Sequence
  Synthetic oligonucleotide
cuuccugccugaugagggg

SEQ ID NO: 1287 - RNA, 19 nt, Artificial Sequence
  Synthetic oligonucleotide
uuccugccugaugagggga

SEQ ID NO: 1288 - RNA, 19 nt, Artificial Sequence
  Synthetic oligonucleotide
uccugccugaugaggggaa

SEQ ID NO: 1289 - RNA, 19 nt, Artificial Sequence
  Synthetic oligonucleotide
ccugccugaugaggggaaa

SEQ ID NO: 1290 - RNA, 19 nt, Artificial Sequence
  Synthetic oligonucleotide
cugccugaugaggggaaac

SEQ ID NO: 1291 - RNA, 19 nt, Artificial Sequence
  Synthetic oligonucleotide
ugccugaugaggggaaacu

SEQ ID NO: 1292 - RNA, 19 nt, Artificial Sequence
  Synthetic oligonucleotide
agcaccuggaaaaugaacu

SEQ ID NO: 1293 - RNA, 19 nt, Artificial Sequence
  Synthetic oligonucleotide
gcaccuggaaaaugaacuc

SEQ ID NO: 1294 - RNA, 19 nt, Artificial Sequence
  Synthetic oligonucleotide
caccuggaaaaugaacuca

SEQ ID NO: 1295 - RNA, 19 nt, Artificial Sequence
  Synthetic oligonucleotide
accuggaaaaugaacucac

SEQ ID NO: 1296 - RNA, 19 nt, Artificial Sequence
  Synthetic oligonucleotide
ccuggaaaaugaacucacc

SEQ ID NO: 1297 - RNA, 19 nt, Artificial Sequence
  Synthetic oligonucleotide
auaucaucaccaaguuccu

SEQ ID NO: 1298 - RNA, 19 nt, Artificial Sequence
  Synthetic oligonucleotide
uaucaucaccaaguuccug

SEQ ID NO: 1299 - RNA, 19 nt, Artificial Sequence
  Synthetic oligonucleotide
aucaucaccaaguuccugg

SEQ ID NO: 1300 - RNA, 19 nt, Artificial Sequence
  Synthetic oligonucleotide
ucaucaccaaguuccugga

SEQ ID NO: 1301 - RNA, 19 nt, Artificial Sequence
  Synthetic oligonucleotide
caucaccaaguuccuggaa

SEQ ID NO: 1302 - RNA, 19 nt, Artificial Sequence
  Synthetic oligonucleotide
aucaccaaguuccuggaaa

SEQ ID NO: 1303 - RNA, 19 nt, Artificial Sequence
  Synthetic oligonucleotide
ucaccaaguuccuggaaaa

SEQ ID NO: 1304 - RNA, 19 nt, Artificial Sequence
  Synthetic oligonucleotide
caccaaguuccuggaaaau

SEQ ID NO: 1305 - RNA, 19 nt, Artificial Sequence
  Synthetic oligonucleotide
accaaguuccuggaaaaug

SEQ ID NO: 1306 - RNA, 19 nt, Artificial Sequence
  Synthetic oligonucleotide
ccaaguuccuggaaaauga

SEQ ID NO: 1307 - RNA, 19 nt, Artificial Sequence
  Synthetic oligonucleotide
aggucuucagcaauggggc

SEQ ID NO: 1308 - RNA, 19 nt, Artificial Sequence
  Synthetic oligonucleotide
caauggggcugaccucucc

SEQ ID NO: 1309 - RNA, 19 nt, Artificial Sequence
  Synthetic oligonucleotide
aauggggcugaccucuccg

SEQ ID NO: 1310 - RNA, 19 nt, Artificial Sequence
  Synthetic oligonucleotide
auggggcugaccucuccgg

SEQ ID NO: 1311 - RNA, 19 nt, Artificial Sequence
  Synthetic oligonucleotide
gaggaggcaccccugaagc

SEQ ID NO: 1312 - RNA, 19 nt, Artificial Sequence
  Synthetic oligonucleotide
ggaggcaccccugaagcuc

SEQ ID NO: 1313 - RNA, 19 nt, Artificial Sequence
  Synthetic oligonucleotide
cugaagcucuccaaggccg

SEQ ID NO: 1314 - RNA, 19 nt, Artificial Sequence
  Synthetic oligonucleotide
cgugcauaaggcugugcug

SEQ ID NO: 1315 - RNA, 19 nt, Artificial Sequence
  Synthetic oligonucleotide
gugcauaaggcugugcuga

SEQ ID NO: 1316 - RNA, 19 nt, Artificial Sequence
  Synthetic oligonucleotide
ugcauaaggcugugcugac

SEQ ID NO: 1317 - RNA, 19 nt, Artificial Sequence
  Synthetic oligonucleotide
gcauaaggcugugcugacc

SEQ ID NO: 1318 - RNA, 19 nt, Artificial Sequence
  Synthetic oligonucleotide
cauaaggcugugcugacca

SEQ ID NO: 1319 - RNA, 19 nt, Artificial Sequence
  Synthetic oligonucleotide
auaaggcugugcugaccau

SEQ ID NO: 1320 - RNA, 19 nt, Artificial Sequence
  Synthetic oligonucleotide
uaaggcugugcugaccauc

SEQ ID NO: 1321 - RNA, 19 nt, Artificial Sequence
  Synthetic oligonucleotide
aaggcugugcugaccaucg

SEQ ID NO: 1322 - RNA, 19 nt, Artificial Sequence
  Synthetic oligonucleotide
aggcugugcugaccaucga

SEQ ID NO: 1323 - RNA, 19 nt, Artificial Sequence
  Synthetic oligonucleotide
acugaagcugcuggggcca

SEQ ID NO: 1324 - RNA, 19 nt, Artificial Sequence
  Synthetic oligonucleotide
cugaagcugcuggggccau

SEQ ID NO: 1325 - RNA, 19 nt, Artificial Sequence
  Synthetic oligonucleotide
ugaagcugcuggggccaug

SEQ ID NO: 1326 - RNA, 19 nt, Artificial Sequence
  Synthetic oligonucleotide
gaagcugcuggggccaugu

SEQ ID NO: 1327 - RNA, 19 nt, Artificial Sequence
  Synthetic oligonucleotide
aagcugcuggggccauguu

SEQ ID NO: 1328 - RNA, 19 nt, Artificial Sequence
  Synthetic oligonucleotide
agcugcuggggccauguuu

SEQ ID NO: 1329 - RNA, 19 nt, Artificial Sequence
  Synthetic oligonucleotide
gccauguuuuuagaggcca

SEQ ID NO: 1330 - RNA, 19 nt, Artificial Sequence
  Synthetic oligonucleotide
ccauguuuuuagaggccau

SEQ ID NO: 1331 - RNA, 19 nt, Artificial Sequence
  Synthetic oligonucleotide
cauguuuuuagaggccaua

SEQ ID NO: 1332 - RNA, 19 nt, Artificial Sequence
  Synthetic oligonucleotide
auguuuuuagaggccauac

SEQ ID NO: 1333 - RNA, 19 nt, Artificial Sequence
  Synthetic oligonucleotide
uguuuuuagaggccauacc

SEQ ID NO: 1334 - RNA, 19 nt, Artificial Sequence
  Synthetic oligonucleotide
guuuuuagaggccauaccc

SEQ ID NO: 1335 - RNA, 19 nt, Artificial Sequence
  Synthetic oligonucleotide
uuuuuagaggccauaccca

SEQ ID NO: 1336 - RNA, 19 nt, Artificial Sequence
  Synthetic oligonucleotide
uuuuagaggccauacccau

SEQ ID NO: 1337 - RNA, 19 nt, Artificial Sequence
  Synthetic oligonucleotide
uuuagaggccauacccaug

SEQ ID NO: 1338 - RNA, 19 nt, Artificial Sequence
  Synthetic oligonucleotide
uuagaggccauacccaugu

SEQ ID NO: 1339 - RNA, 19 nt, Artificial Sequence
  Synthetic oligonucleotide
uagaggccauacccauguc

SEQ ID NO: 1340 - RNA, 19 nt, Artificial Sequence
  Synthetic oligonucleotide
agaggccauacccaugucu

SEQ ID NO: 1341 - RNA, 19 nt, Artificial Sequence
  Synthetic oligonucleotide
guucaacaaacccuuuguc

SEQ ID NO: 1342 - RNA, 19 nt, Artificial Sequence
  Synthetic oligonucleotide
uucaacaaacccuuugucu

SEQ ID NO: 1343 - RNA, 19 nt, Artificial Sequence
  Synthetic oligonucleotide
ucaacaaacccuuugucuu

SEQ ID NO: 1344 - RNA, 19 nt, Artificial Sequence
  Synthetic oligonucleotide
caacaaacccuuugucuuc

SEQ ID NO: 1345 - RNA, 19 nt, Artificial Sequence
  Synthetic oligonucleotide
aacaaacccuuugucuucu

SEQ ID NO: 1346 - RNA, 19 nt, Artificial Sequence
  Synthetic oligonucleotide
acaaacccuuugucuucuu

SEQ ID NO: 1347 - RNA, 19 nt, Artificial Sequence
  Synthetic oligonucleotide
caaacccuuugucuucuua

SEQ ID NO: 1348 - RNA, 19 nt, Artificial Sequence
  Synthetic oligonucleotide
aaacccuuugucuucuuaa

SEQ ID NO: 1349 - RNA, 19 nt, Artificial Sequence
  Synthetic oligonucleotide
aacccuuugucuucuuaau

SEQ ID NO: 1350 - RNA, 19 nt, Artificial Sequence
  Synthetic oligonucleotide
aauaccaagucuccccucu

SEQ ID NO: 1351 - RNA, 19 nt, Artificial Sequence
  Synthetic oligonucleotide
auaccaagucuccccucuu

SEQ ID NO: 1352 - RNA, 19 nt, Artificial Sequence
  Synthetic oligonucleotide
uaccaagucuccccucuuc

SEQ ID NO: 1353 - RNA, 19 nt, Artificial Sequence
  Synthetic oligonucleotide
accaagucuccccucuuca

SEQ ID NO: 1354 - RNA, 19 nt, Artificial Sequence
  Synthetic oligonucleotide
ccaagucuccccucuucau

SEQ ID NO: 1355 - RNA, 19 nt, Artificial Sequence
  Synthetic oligonucleotide
caagucuccccucuucaug

SEQ ID NO: 1356 - RNA, 19 nt, Artificial Sequence
  Synthetic oligonucleotide
aagucuccccucuucaugg

SEQ ID NO: 1357 - RNA, 19 nt, Artificial Sequence
  Synthetic oligonucleotide
agucuccccucuucauggg

SEQ ID NO: 1358 - RNA, 19 nt, Artificial Sequence
  Synthetic oligonucleotide
gucuccccucuucauggga

SEQ ID NO: 1359 - RNA, 19 nt, Artificial Sequence
  Synthetic oligonucleotide
cuccccucuucaugggaaa

SEQ ID NO: 1360 - RNA, 19 nt, Artificial Sequence
  Synthetic oligonucleotide
ccccucuucaugggaaaag

SEQ ID NO: 1361 - RNA, 19 nt, Artificial Sequence
  Synthetic oligonucleotide
cccucuucaugggaaaagu

SEQ ID NO: 1362 - RNA, 19 nt, Artificial Sequence
  Synthetic oligonucleotide
ccucuucaugggaaaagug

SEQ ID NO: 1363 - RNA, 19 nt, Artificial Sequence
  Synthetic oligonucleotide
cucuucaugggaaaagugg

SEQ ID NO: 1364 - RNA, 19 nt, Artificial Sequence
  Synthetic oligonucleotide
ucuucaugggaaaaguggu

SEQ ID NO: 1365 - RNA, 19 nt, Artificial Sequence
  Synthetic oligonucleotide
cuucaugggaaaaguggug

SEQ ID NO: 1366 - RNA, 19 nt, Artificial Sequence
  Synthetic oligonucleotide
uucaugggaaaagugguga

SEQ ID NO: 1367 - RNA, 19 nt, Artificial Sequence
  Synthetic oligonucleotide
ucaugggaaaaguggugaa

SEQ ID NO: 1368 - RNA, 19 nt, Artificial Sequence
  Synthetic oligonucleotide
caugggaaaaguggugaau

SEQ ID NO: 1369 - RNA, 19 nt, Artificial Sequence
  Synthetic oligonucleotide
augggaaaaguggugaauc

SEQ ID NO: 1370 - RNA, 19 nt, Artificial Sequence
  Synthetic oligonucleotide
ugggaaaaguggugaaucc

SEQ ID NO: 1371 - RNA, 19 nt, Artificial Sequence
  Synthetic oligonucleotide
gggaaaaguggugaauccc

SEQ ID NO: 1372 - RNA, 19 nt, Artificial Sequence
  Synthetic oligonucleotide
ggaaaaguggugaauccca

SEQ ID NO: 1373 - RNA, 19 nt, Artificial Sequence
  Synthetic oligonucleotide
gaaaaguggugaaucccac

SEQ ID NO: 1374 - RNA, 19 nt, Artificial Sequence
  Synthetic oligonucleotide
aaaaguggugaaucccacc

SEQ ID NO: 1375 - RNA, 19 nt, Artificial Sequence
  Synthetic oligonucleotide
aaaguggugaaucccaccc

SEQ ID NO: 1376 - RNA, 19 nt, Artificial Sequence
  Synthetic oligonucleotide
aaguggugaaucccaccca

SEQ ID NO: 1377 - RNA, 19 nt, Artificial Sequence
  Synthetic oligonucleotide
cgauaguucaaaaugguga

SEQ ID NO: 1378 - RNA, 19 nt, Artificial Sequence
  Synthetic oligonucleotide
caaaauggugaaauuagca

SEQ ID NO: 1379 - RNA, 19 nt, Artificial Sequence
  Synthetic oligonucleotide
uugguaugauguucaaguu

SEQ ID NO: 1380 - RNA, 19 nt, Artificial Sequence
  Synthetic oligonucleotide
gguaugauguucaaguuag

SEQ ID NO: 1381 - RNA, 19 nt, Artificial Sequence
  Synthetic oligonucleotide
guaugauguucaaguuaga

SEQ ID NO: 1382 - RNA, 19 nt, Artificial Sequence
  Synthetic oligonucleotide
augauguucaaguuagaua

SEQ ID NO: 1383 - RNA, 19 nt, Artificial Sequence
  Synthetic oligonucleotide
auguucaaguuagauaaca

SEQ ID NO: 1384 - RNA, 19 nt, Artificial Sequence
  Synthetic oligonucleotide
caaguuagauaacaaaaug

SEQ ID NO: 1385 - RNA, 19 nt, Artificial Sequence
  Synthetic oligonucleotide
aaguuagauaacaaaaugu

SEQ ID NO: 1386 - RNA, 19 nt, Artificial Sequence
  Synthetic oligonucleotide
aguuagauaacaaaauguu

SEQ ID NO: 1387 - RNA, 19 nt, Artificial Sequence
  Synthetic oligonucleotide
acaucccaccaugaucagg

SEQ ID NO: 1388 - RNA, 19 nt, Artificial Sequence
  Synthetic oligonucleotide
ccagcuggcacaccagucc

SEQ ID NO: 1389 - RNA, 19 nt, Artificial Sequence
  Synthetic oligonucleotide
agcuggcacaccaguccaa

SEQ ID NO: 1390 - RNA, 19 nt, Artificial Sequence
  Synthetic oligonucleotide
uggcacaccaguccaacag

SEQ ID NO: 1391 - RNA, 19 nt, Artificial Sequence
  Synthetic oligonucleotide
ggcacaccaguccaacagc

SEQ ID NO: 1392 - RNA, 19 nt, Artificial Sequence
  Synthetic oligonucleotide
gcacaccaguccaacagca

SEQ ID NO: 1393 - RNA, 19 nt, Artificial Sequence
  Synthetic oligonucleotide
cacaccaguccaacagcac

SEQ ID NO: 1394 - RNA, 19 nt, Artificial Sequence
  Synthetic oligonucleotide
acaccaguccaacagcacc

SEQ ID NO: 1395 - RNA, 19 nt, Artificial Sequence
  Synthetic oligonucleotide
accaauaucuucuucuccc

SEQ ID NO: 1396 - RNA, 19 nt, Artificial Sequence
  Synthetic oligonucleotide
ccaauaucuucuucucccc

SEQ ID NO: 1397 - RNA, 19 nt, Artificial Sequence
  Synthetic oligonucleotide
caauaucuucuucucccca

SEQ ID NO: 1398 - RNA, 19 nt, Artificial Sequence
  Synthetic oligonucleotide
aauaucuucuucuccccag

SEQ ID NO: 1399 - RNA, 19 nt, Artificial Sequence
  Synthetic oligonucleotide
auaucuucuucuccccagu

SEQ ID NO: 1400 - RNA, 19 nt, Artificial Sequence
  Synthetic oligonucleotide
uaucuucuucuccccagug

SEQ ID NO: 1401 - RNA, 19 nt, Artificial Sequence
  Synthetic oligonucleotide
aucuucuucuccccaguga

SEQ ID NO: 1402 - RNA, 19 nt, Artificial Sequence
  Synthetic oligonucleotide
ucuucuucuccccagugag

SEQ ID NO: 1403 - RNA, 19 nt, Artificial Sequence
  Synthetic oligonucleotide
cuucuucuccccagugagc

SEQ ID NO: 1404 - RNA, 19 nt, Artificial Sequence
  Synthetic oligonucleotide
uucuucuccccagugagca

SEQ ID NO: 1405 - RNA, 19 nt, Artificial Sequence
  Synthetic oligonucleotide
ucuucuccccagugagcau

SEQ ID NO: 1406 - RNA, 19 nt, Artificial Sequence
  Synthetic oligonucleotide
uucuccccagugagcaucg

SEQ ID NO: 1407 - RNA, 19 nt, Artificial Sequence
  Synthetic oligonucleotide
ucuccccagugagcaucgc

SEQ ID NO: 1408 - RNA, 19 nt, Artificial Sequence
  Synthetic oligonucleotide
uccccagugagcaucgcua

SEQ ID NO: 1409 - RNA, 19 nt, Artificial Sequence
  Synthetic oligonucleotide
uacagccuuugcaaugcuc

SEQ ID NO: 1410 - RNA, 19 nt, Artificial Sequence
  Synthetic oligonucleotide
uugcaaugcucucccuggg

SEQ ID NO: 1411 - RNA, 19 nt, Artificial Sequence
  Synthetic oligonucleotide
gaaauccuggagggccuga

SEQ ID NO: 1412 - RNA, 19 nt, Artificial Sequence
  Synthetic oligonucleotide
aaauccuggagggccugaa

SEQ ID NO: 1413 - RNA, 19 nt, Artificial Sequence
  Synthetic oligonucleotide
aauccuggagggccugaau

SEQ ID NO: 1414 - RNA, 19 nt, Artificial Sequence
  Synthetic oligonucleotide
uccuggagggccugaauuu

SEQ ID NO: 1415 - RNA, 19 nt, Artificial Sequence
  Synthetic oligonucleotide
ccuggagggccugaauuuc

SEQ ID NO: 1416 - RNA, 19 nt, Artificial Sequence
  Synthetic oligonucleotide
cuggagggccugaauuuca

SEQ ID NO: 1417 - RNA, 19 nt, Artificial Sequence
  Synthetic oligonucleotide
ccaugaaggcuuccaggaa

SEQ ID NO: 1418 - RNA, 19 nt, Artificial Sequence
  Synthetic oligonucleotide
ugaaggcuuccaggaacuc

SEQ ID NO: 1419 - RNA, 19 nt, Artificial Sequence
  Synthetic oligonucleotide
gaaggcuuccaggaacucc

SEQ ID NO: 1420 - RNA, 19 nt, Artificial Sequence
  Synthetic oligonucleotide
cagccagacagccagcucc

SEQ ID NO: 1421 - RNA, 19 nt, Artificial Sequence
  Synthetic oligonucleotide
gccagacagccagcuccag

SEQ ID NO: 1422 - RNA, 19 nt, Artificial Sequence
  Synthetic oligonucleotide
cagacagccagcuccagcu

SEQ ID NO: 1423 - RNA, 19 nt, Artificial Sequence
  Synthetic oligonucleotide
agacagccagcuccagcug

SEQ ID NO: 1424 - RNA, 19 nt, Artificial Sequence
  Synthetic oligonucleotide
cuaguggauaaguuuuugg

SEQ ID NO: 1425 - RNA, 19 nt, Artificial Sequence
  Synthetic oligonucleotide
uaguggauaaguuuuugga

SEQ ID NO: 1426 - RNA, 19 nt, Artificial Sequence
  Synthetic oligonucleotide
aguggauaaguuuuuggag

SEQ ID NO: 1427 - RNA, 19 nt, Artificial Sequence
  Synthetic oligonucleotide
guggauaaguuuuuggagg

SEQ ID NO: 1428 - RNA, 19 nt, Artificial Sequence
  Synthetic oligonucleotide
uggauaaguuuuuggagga

SEQ ID NO: 1429 - RNA, 19 nt, Artificial Sequence
  Synthetic oligonucleotide
ggauaaguuuuuggaggau

SEQ ID NO: 1430 - RNA, 19 nt, Artificial Sequence
  Synthetic oligonucleotide
gauaaguuuuuggaggaug

SEQ ID NO: 1431 - RNA, 19 nt, Artificial Sequence
  Synthetic oligonucleotide
uuguaccacucagaagccu

SEQ ID NO: 1432 - RNA, 19 nt, Artificial Sequence
  Synthetic oligonucleotide
uguaccacucagaagccuu

SEQ ID NO: 1433 - RNA, 19 nt, Artificial Sequence
  Synthetic oligonucleotide
uacucaagggaaaauugug

SEQ ID NO: 1434 - RNA, 19 nt, Artificial Sequence
  Synthetic oligonucleotide
acucaagggaaaauugugg

SEQ ID NO: 1435 - RNA, 19 nt, Artificial Sequence
  Synthetic oligonucleotide
cucaagggaaaauugugga

SEQ ID NO: 1436 - RNA, 19 nt, Artificial Sequence
  Synthetic oligonucleotide
ucaagggaaaauuguggau

SEQ ID NO: 1437 - RNA, 19 nt, Artificial Sequence
  Synthetic oligonucleotide
caagggaaaauuguggauu

SEQ ID NO: 1438 - RNA, 19 nt, Artificial Sequence
  Synthetic oligonucleotide
aagggaaaauuguggauuu

SEQ ID NO: 1439 - RNA, 19 nt, Artificial Sequence
  Synthetic oligonucleotide
agggaaaauuguggauuug

SEQ ID NO: 1440 - RNA, 19 nt, Artificial Sequence
  Synthetic oligonucleotide
gggaaaauuguggauuugg

SEQ ID NO: 1441 - RNA, 19 nt, Artificial Sequence
  Synthetic oligonucleotide
ggaaaauuguggauuuggu

SEQ ID NO: 1442 - RNA, 19 nt, Artificial Sequence
  Synthetic oligonucleotide
gaaaauuguggauuugguc

SEQ ID NO: 1443 - RNA, 19 nt, Artificial Sequence
  Synthetic oligonucleotide
aaaauuguggauuugguca

SEQ ID NO: 1444 - RNA, 19 nt, Artificial Sequence
  Synthetic oligonucleotide
aaauuguggauuuggucaa

SEQ ID NO: 1445 - RNA, 19 nt, Artificial Sequence
  Synthetic oligonucleotide
aauuguggauuuggucaag

SEQ ID NO: 1446 - RNA, 19 nt, Artificial Sequence
  Synthetic oligonucleotide
auuguggauuuggucaagg

SEQ ID NO: 1447 - RNA, 19 nt, Artificial Sequence
  Synthetic oligonucleotide
uuguggauuuggucaagga

SEQ ID NO: 1448 - RNA, 19 nt, Artificial Sequence
  Synthetic oligonucleotide
uguggauuuggucaaggag

SEQ ID NO: 1449 - RNA, 19 nt, Artificial Sequence
  Synthetic oligonucleotide
guggauuuggucaaggagc

SEQ ID NO: 1450 - RNA, 19 nt, Artificial Sequence
  Synthetic oligonucleotide
uggauuuggucaaggagcu

SEQ ID NO: 1451 - RNA, 19 nt, Artificial Sequence
  Synthetic oligonucleotide
ggauuuggucaaggagcuu

SEQ ID NO: 1452 - RNA, 19 nt, Artificial Sequence
  Synthetic oligonucleotide
gauuuggucaaggagcuug

SEQ ID NO: 1453 - RNA, 19 nt, Artificial Sequence
  Synthetic oligonucleotide
auuuggucaaggagcuuga

SEQ ID NO: 1454 - RNA, 19 nt, Artificial Sequence
  Synthetic oligonucleotide
uuuggucaaggagcuugac

SEQ ID NO: 1455 - RNA, 19 nt, Artificial Sequence
  Synthetic oligonucleotide
uuggucaaggagcuugaca

SEQ ID NO: 1456 - RNA, 19 nt, Artificial Sequence
  Synthetic oligonucleotide
acaguuuuugcucugguga

SEQ ID NO: 1457 - RNA, 19 nt, Artificial Sequence
  Synthetic oligonucleotide
caguuuuugcucuggugaa

SEQ ID NO: 1458 - RNA, 19 nt, Artificial Sequence
  Synthetic oligonucleotide
aguuuuugcucuggugaau

SEQ ID NO: 1459 - RNA, 19 nt, Artificial Sequence
  Synthetic oligonucleotide
guuuuugcucuggugaauu

SEQ ID NO: 1460 - RNA, 19 nt, Artificial Sequence
  Synthetic oligonucleotide
uaaaggcaaaugggagaga

SEQ ID NO: 1461 - RNA, 19 nt, Artificial Sequence
  Synthetic oligonucleotide
aaaggcaaaugggagagac

SEQ ID NO: 1462 - RNA, 19 nt, Artificial Sequence
  Synthetic oligonucleotide
aaggcaaaugggagagacc

SEQ ID NO: 1463 - RNA, 19 nt, Artificial Sequence
  Synthetic oligonucleotide
aggcaaaugggagagaccc

SEQ ID NO: 1464 - RNA, 19 nt, Artificial Sequence
  Synthetic oligonucleotide
gaggaagaggacuuccacg

SEQ ID NO: 1465 - RNA, 19 nt, Artificial Sequence
  Synthetic oligonucleotide
aggaagaggacuuccacgu

SEQ ID NO: 1466 - RNA, 19 nt, Artificial Sequence
  Synthetic oligonucleotide
ggaagaggacuuccacgug

SEQ ID NO: 1467 - RNA, 19 nt, Artificial Sequence
  Synthetic oligonucleotide
gaagaggacuuccacgugg

SEQ ID NO: 1468 - RNA, 19 nt, Artificial Sequence
  Synthetic oligonucleotide
agaggacuuccacguggac

SEQ ID NO: 1469 - RNA, 19 nt, Artificial Sequence
  Synthetic oligonucleotide
gaggacuuccacguggacc

SEQ ID NO: 1470 - RNA, 19 nt, Artificial Sequence
  Synthetic oligonucleotide
ggacuuccacguggaccag

SEQ ID NO: 1471 - RNA, 19 nt, Artificial Sequence
  Synthetic oligonucleotide
cguuuaggcauguuuaaca

SEQ ID NO: 1472 - RNA, 19 nt, Artificial Sequence
  Synthetic oligonucleotide
guuuaggcauguuuaacau

SEQ ID NO: 1473 - RNA, 19 nt, Artificial Sequence
  Synthetic oligonucleotide
agcuguccagcugggugcu

SEQ ID NO: 1474 - RNA, 19 nt, Artificial Sequence
  Synthetic oligonucleotide
gcuguccagcugggugcug

SEQ ID NO: 1475 - RNA, 19 nt, Artificial Sequence
  Synthetic oligonucleotide
gcaaugccaccgccaucuu

SEQ ID NO: 1476 - RNA, 19 nt, Artificial Sequence
  Synthetic oligonucleotide
caaugccaccgccaucuuc

SEQ ID NO: 1477 - RNA, 19 nt, Artificial Sequence
  Synthetic oligonucleotide
gccaccgccaucuucuucc

SEQ ID NO: 1478 - RNA, 19 nt, Artificial Sequence
  Synthetic oligonucleotide
ccaccgccaucuucuuccu

SEQ ID NO: 1479 - RNA, 19 nt, Artificial Sequence
  Synthetic oligonucleotide
caccgccaucuucuuccug

SEQ ID NO: 1480 - RNA, 19 nt, Artificial Sequence
  Synthetic oligonucleotide
accgccaucuucuuccugc

SEQ ID NO: 1481 - RNA, 19 nt, Artificial Sequence
  Synthetic oligonucleotide
ccgccaucuucuuccugcc

SEQ ID NO: 1482 - RNA, 19 nt, Artificial Sequence
  Synthetic oligonucleotide
cgccaucuucuuccugccu

SEQ ID NO: 1483 - RNA, 19 nt, Artificial Sequence
  Synthetic oligonucleotide
caucuucuuccugccugau

SEQ ID NO: 1484 - RNA, 19 nt, Artificial Sequence
  Synthetic oligonucleotide
ucuuccugccugaugaggg

SEQ ID NO: 1485 - RNA, 19 nt, Artificial Sequence
  Synthetic oligonucleotide
cuuccugccugaugagggg

SEQ ID NO: 1486 - RNA, 19 nt, Artificial Sequence
  Synthetic oligonucleotide
uuccugccugaugagggga

SEQ ID NO: 1487 - RNA, 19 nt, Artificial Sequence
  Synthetic oligonucleotide
uccugccugaugaggggaa

SEQ ID NO: 1488 - RNA, 19 nt, Artificial Sequence
  Synthetic oligonucleotide
ccugccugaugaggggaaa

SEQ ID NO: 1489 - RNA, 19 nt, Artificial Sequence
  Synthetic oligonucleotide
cugccugaugaggggaaac

SEQ ID NO: 1490 - RNA, 19 nt, Artificial Sequence
  Synthetic oligonucleotide
cagcaccuggaaaaugaac

SEQ ID NO: 1491 - RNA, 19 nt, Artificial Sequence
  Synthetic oligonucleotide
agcaccuggaaaaugaacu

SEQ ID NO: 1492 - RNA, 19 nt, Artificial Sequence
  Synthetic oligonucleotide
gcaccuggaaaaugaacuc

SEQ ID NO: 1493 - RNA, 19 nt, Artificial Sequence
  Synthetic oligonucleotide
caccuggaaaaugaacuca

SEQ ID NO: 1494 - RNA, 19 nt, Artificial Sequence
  Synthetic oligonucleotide
accuggaaaaugaacucac

SEQ ID NO: 1495 - RNA, 19 nt, Artificial Sequence
  Synthetic oligonucleotide
gauaucaucaccaaguucc

SEQ ID NO: 1496 - RNA, 19 nt, Artificial Sequence
  Synthetic oligonucleotide
auaucaucaccaaguuccu

SEQ ID NO: 1497 - RNA, 19 nt, Artificial Sequence
  Synthetic oligonucleotide
uaucaucaccaaguuccug

SEQ ID NO: 1498 - RNA, 19 nt, Artificial Sequence
  Synthetic oligonucleotide
aucaucaccaaguuccugg

SEQ ID NO: 1499 - RNA, 19 nt, Artificial Sequence
  Synthetic oligonucleotide
ucaucaccaaguuccugga

SEQ ID NO: 1500 - RNA, 19 nt, Artificial Sequence
  Synthetic oligonucleotide
caucaccaaguuccuggaa

SEQ ID NO: 1501 - RNA, 19 nt, Artificial Sequence
  Synthetic oligonucleotide
aucaccaaguuccuggaaa

SEQ ID NO: 1502 - RNA, 19 nt, Artificial Sequence
  Synthetic oligonucleotide
ucaccaaguuccuggaaaa

SEQ ID NO: 1503 - RNA, 19 nt, Artificial Sequence
  Synthetic oligonucleotide
caccaaguuccuggaaaau

SEQ ID NO: 1504 - RNA, 19 nt, Artificial Sequence
  Synthetic oligonucleotide
accaaguuccuggaaaaug

SEQ ID NO: 1505 - RNA, 19 nt, Artificial Sequence
  Synthetic oligonucleotide
aaggucuucagcaaugggg

SEQ ID NO: 1506 - RNA, 19 nt, Artificial Sequence
  Synthetic oligonucleotide
gcaauggggcugaccucuc

SEQ ID NO: 1507 - RNA, 19 nt, Artificial Sequence
  Synthetic oligonucleotide
caauggggcugaccucucc

SEQ ID NO: 1508 - RNA, 19 nt, Artificial Sequence
  Synthetic oligonucleotide
aauggggcugaccucuccg

SEQ ID NO: 1509 - RNA, 19 nt, Artificial Sequence
  Synthetic oligonucleotide
agaggaggcaccccugaag

SEQ ID NO: 1510 - RNA, 19 nt, Artificial Sequence
  Synthetic oligonucleotide
aggaggcaccccugaagcu

SEQ ID NO: 1511 - RNA, 19 nt, Artificial Sequence
  Synthetic oligonucleotide
ccugaagcucuccaaggcc

SEQ ID NO: 1512 - RNA, 19 nt, Artificial Sequence
  Synthetic oligonucleotide
ccgugcauaaggcugugcu

SEQ ID NO: 1513 - RNA, 19 nt, Artificial Sequence
  Synthetic oligonucleotide
cgugcauaaggcugugcug

SEQ ID NO: 1514 - RNA, 19 nt, Artificial Sequence
  Synthetic oligonucleotide
gugcauaaggcugugcuga

SEQ ID NO: 1515 - RNA, 19 nt, Artificial Sequence
  Synthetic oligonucleotide
ugcauaaggcugugcugac

SEQ ID NO: 1516 - RNA, 19 nt, Artificial Sequence
  Synthetic oligonucleotide
gcauaaggcugugcugacc

SEQ ID NO: 1517 - RNA, 19 nt, Artificial Sequence
  Synthetic oligonucleotide
cauaaggcugugcugacca

SEQ ID NO: 1518 - RNA, 19 nt, Artificial Sequence
  Synthetic oligonucleotide
auaaggcugugcugaccau

SEQ ID NO: 1519 - RNA, 19 nt, Artificial Sequence
  Synthetic oligonucleotide
uaaggcugugcugaccauc

SEQ ID NO: 1520 - RNA, 19 nt, Artificial Sequence
  Synthetic oligonucleotide
aaggcugugcugaccaucg

SEQ ID NO: 1521 - RNA, 19 nt, Artificial Sequence
  Synthetic oligonucleotide
gacugaagcugcuggggcc

SEQ ID NO: 1522 - RNA, 19 nt, Artificial Sequence
  Synthetic oligonucleotide
acugaagcugcuggggcca

SEQ ID NO: 1523 - RNA, 19 nt, Artificial Sequence
  Synthetic oligonucleotide
cugaagcugcuggggccau

SEQ ID NO: 1524 - RNA, 19 nt, Artificial Sequence
  Synthetic oligonucleotide
ugaagcugcuggggccaug

SEQ ID NO: 1525 - RNA, 19 nt, Artificial Sequence
  Synthetic oligonucleotide
gaagcugcuggggccaugu

SEQ ID NO: 1526 - RNA, 19 nt, Artificial Sequence
  Synthetic oligonucleotide
aagcugcuggggccauguu

SEQ ID NO: 1527 - RNA, 19 nt, Artificial Sequence
  Synthetic oligonucleotide
ggccauguuuuuagaggcc

SEQ ID NO: 1528 - RNA, 19 nt, Artificial Sequence
  Synthetic oligonucleotide
gccauguuuuuagaggcca

SEQ ID NO: 1529 - RNA, 19 nt, Artificial Sequence
  Synthetic oligonucleotide
ccauguuuuuagaggccau

SEQ ID NO: 1530 - RNA, 19 nt, Artificial Sequence
  Synthetic oligonucleotide
cauguuuuuagaggccaua

SEQ ID NO: 1531 - RNA, 19 nt, Artificial Sequence
  Synthetic oligonucleotide
auguuuuuagaggccauac

SEQ ID NO: 1532 - RNA, 19 nt, Artificial Sequence
  Synthetic oligonucleotide
uguuuuuagaggccauacc

SEQ ID NO: 1533 - RNA, 19 nt, Artificial Sequence
  Synthetic oligonucleotide
guuuuuagaggccauaccc

SEQ ID NO: 1534 - RNA, 19 nt, Artificial Sequence
  Synthetic oligonucleotide
uuuuuagaggccauaccca

SEQ ID NO: 1535 - RNA, 19 nt, Artificial Sequence
  Synthetic oligonucleotide
uuuuagaggccauacccau

SEQ ID NO: 1536 - RNA, 19 nt, Artificial Sequence
  Synthetic oligonucleotide
uuuagaggccauacccaug

SEQ ID NO: 1537 - RNA, 19 nt, Artificial Sequence
  Synthetic oligonucleotide
uuagaggccauacccaugu

SEQ ID NO: 1538 - RNA, 19 nt, Artificial Sequence
  Synthetic oligonucleotide
uagaggccauacccauguc

SEQ ID NO: 1539 - RNA, 19 nt, Artificial Sequence
  Synthetic oligonucleotide
aguucaacaaacccuuugu

SEQ ID NO: 1540 - RNA, 19 nt, Artificial Sequence
  Synthetic oligonucleotide
guucaacaaacccuuuguc

SEQ ID NO: 1541 - RNA, 19 nt, Artificial Sequence
  Synthetic oligonucleotide
uucaacaaacccuuugucu

SEQ ID NO: 1542 - RNA, 19 nt, Artificial Sequence
  Synthetic oligonucleotide
ucaacaaacccuuugucuu

SEQ ID NO: 1543 - RNA, 19 nt, Artificial Sequence
  Synthetic oligonucleotide
caacaaacccuuugucuuc

SEQ ID NO: 1544 - RNA, 19 nt, Artificial Sequence
  Synthetic oligonucleotide
aacaaacccuuugucuucu

SEQ ID NO: 1545 - RNA, 19 nt, Artificial Sequence
  Synthetic oligonucleotide
acaaacccuuugucuucuu

SEQ ID NO: 1546 - RNA, 19 nt, Artificial Sequence
  Synthetic oligonucleotide
caaacccuuugucuucuua

SEQ ID NO: 1547 - RNA, 19 nt, Artificial Sequence
  Synthetic oligonucleotide
aaacccuuugucuucuuaa

SEQ ID NO: 1548 - RNA, 19 nt, Artificial Sequence
  Synthetic oligonucleotide
aaauaccaagucuccccuc

SEQ ID NO: 1549 - RNA, 19 nt, Artificial Sequence
  Synthetic oligonucleotide
aauaccaagucuccccucu

SEQ ID NO: 1550 - RNA, 19 nt, Artificial Sequence
  Synthetic oligonucleotide
auaccaagucuccccucuu

SEQ ID NO: 1551 - RNA, 19 nt, Artificial Sequence
  Synthetic oligonucleotide
uaccaagucuccccucuuc

SEQ ID NO: 1552 - RNA, 19 nt, Artificial Sequence
  Synthetic oligonucleotide
accaagucuccccucuuca

SEQ ID NO: 1553 - RNA, 19 nt, Artificial Sequence
  Synthetic oligonucleotide
ccaagucuccccucuucau

SEQ ID NO: 1554 - RNA, 19 nt, Artificial Sequence
  Synthetic oligonucleotide
caagucuccccucuucaug

SEQ ID NO: 1555 - RNA, 19 nt, Artificial Sequence
  Synthetic oligonucleotide
aagucuccccucuucaugg

SEQ ID NO: 1556 - RNA, 19 nt, Artificial Sequence
  Synthetic oligonucleotide
agucuccccucuucauggg

SEQ ID NO: 1557 - RNA, 19 nt, Artificial Sequence
  Synthetic oligonucleotide
ucuccccucuucaugggaa

SEQ ID NO: 1558 - RNA, 19 nt, Artificial Sequence
  Synthetic oligonucleotide
uccccucuucaugggaaaa

SEQ ID NO: 1559 - RNA, 19 nt, Artificial Sequence
  Synthetic oligonucleotide
ccccucuucaugggaaaag

SEQ ID NO: 1560 - RNA, 19 nt, Artificial Sequence
  Synthetic oligonucleotide
cccucuucaugggaaaagu

SEQ ID NO: 1561 - RNA, 19 nt, Artificial Sequence
  Synthetic oligonucleotide
ccucuucaugggaaaagug

SEQ ID NO: 1562 - RNA, 19 nt, Artificial Sequence
  Synthetic oligonucleotide
cucuucaugggaaaagugg

SEQ ID NO: 1563 - RNA, 19 nt, Artificial Sequence
  Synthetic oligonucleotide
ucuucaugggaaaaguggu

SEQ ID NO: 1564 - RNA, 19 nt, Artificial Sequence
  Synthetic oligonucleotide
cuucaugggaaaaguggug

SEQ ID NO: 1565 - RNA, 19 nt, Artificial Sequence
  Synthetic oligonucleotide
uucaugggaaaagugguga

SEQ ID NO: 1566 - RNA, 19 nt, Artificial Sequence
  Synthetic oligonucleotide
ucaugggaaaaguggugaa

SEQ ID NO: 1567 - RNA, 19 nt, Artificial Sequence
  Synthetic oligonucleotide
caugggaaaaguggugaau

SEQ ID NO: 1568 - RNA, 19 nt, Artificial Sequence
  Synthetic oligonucleotide
augggaaaaguggugaauc

SEQ ID NO: 1569 - RNA, 19 nt, Artificial Sequence
  Synthetic oligonucleotide
ugggaaaaguggugaaucc

SEQ ID NO: 1570 - RNA, 19 nt, Artificial Sequence
  Synthetic oligonucleotide
gggaaaaguggugaauccc

SEQ ID NO: 1571 - RNA, 19 nt, Artificial Sequence
  Synthetic oligonucleotide
ggaaaaguggugaauccca

SEQ ID NO: 1572 - RNA, 19 nt, Artificial Sequence
  Synthetic oligonucleotide
gaaaaguggugaaucccac

SEQ ID NO: 1573 - RNA, 19 nt, Artificial Sequence
  Synthetic oligonucleotide
aaaaguggugaaucccacc

SEQ ID NO: 1574 - RNA, 19 nt, Artificial Sequence
  Synthetic oligonucleotide
aaaguggugaaucccaccc

SEQ ID NO: 1575 - RNA, 19 nt, Artificial Sequence
  Synthetic oligonucleotide
ucgauaguucaaaauggug

SEQ ID NO: 1576 - RNA, 19 nt, Artificial Sequence
  Synthetic oligonucleotide
ucaaaauggugaaauuagc

SEQ ID NO: 1577 - RNA, 19 nt, Artificial Sequence
  Synthetic oligonucleotide
guugguaugauguucaagu

SEQ ID NO: 1578 - RNA, 19 nt, Artificial Sequence
  Synthetic oligonucleotide
ugguaugauguucaaguua

SEQ ID NO: 1579 - RNA, 19 nt, Artificial Sequence
  Synthetic oligonucleotide
gguaugauguucaaguuag

SEQ ID NO: 1580 - RNA, 19 nt, Artificial Sequence
  Synthetic oligonucleotide
uaugauguucaaguuagau

SEQ ID NO: 1581 - RNA, 19 nt, Artificial Sequence
  Synthetic oligonucleotide
gauguucaaguuagauaac

SEQ ID NO: 1582 - RNA, 19 nt, Artificial Sequence
  Synthetic oligonucleotide
ucaaguuagauaacaaaau

SEQ ID NO: 1583 - RNA, 19 nt, Artificial Sequence
  Synthetic oligonucleotide
caaguuagauaacaaaaug

SEQ ID NO: 1584 - RNA, 19 nt, Artificial Sequence
  Synthetic oligonucleotide
aaguuagauaacaaaaugu

SEQ ID NO: 1585 - RNA, 19 nt, Artificial Sequence
  Synthetic oligonucleotide
uacaucccaccaugaucag

SEQ ID NO: 1586 - RNA, 19 nt, Artificial Sequence
  Synthetic oligonucleotide
gccagcuggcacaccaguc

SEQ ID NO: 1587 - RNA, 19 nt, Artificial Sequence
  Synthetic oligonucleotide
cagcuggcacaccagucca

SEQ ID NO: 1588 - RNA, 19 nt, Artificial Sequence
  Synthetic oligonucleotide
cuggcacaccaguccaaca

SEQ ID NO: 1589 - RNA, 19 nt, Artificial Sequence
  Synthetic oligonucleotide
uggcacaccaguccaacag

SEQ ID NO: 1590 - RNA, 19 nt, Artificial Sequence
  Synthetic oligonucleotide
ggcacaccaguccaacagc

SEQ ID NO: 1591 - RNA, 19 nt, Artificial Sequence
  Synthetic oligonucleotide
gcacaccaguccaacagca

SEQ ID NO: 1592 - RNA, 19 nt, Artificial Sequence
  Synthetic oligonucleotide
cacaccaguccaacagcac

SEQ ID NO: 1593 - RNA, 19 nt, Artificial Sequence
  Synthetic oligonucleotide
caccaauaucuucuucucc

SEQ ID NO: 1594 - RNA, 19 nt, Artificial Sequence
  Synthetic oligonucleotide
accaauaucuucuucuccc

SEQ ID NO: 1595 - RNA, 19 nt, Artificial Sequence
  Synthetic oligonucleotide
ccaauaucuucuucucccc

SEQ ID NO: 1596 - RNA, 19 nt, Artificial Sequence
  Synthetic oligonucleotide
caauaucuucuucucccca

SEQ ID NO: 1597 - RNA, 19 nt, Artificial Sequence
  Synthetic oligonucleotide
aauaucuucuucuccccag

SEQ ID NO: 1598 - RNA, 19 nt, Artificial Sequence
  Synthetic oligonucleotide
auaucuucuucuccccagu

SEQ ID NO: 1599 - RNA, 19 nt, Artificial Sequence
  Synthetic oligonucleotide
uaucuucuucuccccagug

SEQ ID NO: 1600 - RNA, 19 nt, Artificial Sequence
  Synthetic oligonucleotide
aucuucuucuccccaguga

SEQ ID NO: 1601 - RNA, 19 nt, Artificial Sequence
  Synthetic oligonucleotide
ucuucuucuccccagugag

SEQ ID NO: 1602 - RNA, 19 nt, Artificial Sequence
  Synthetic oligonucleotide
cuucuucuccccagugagc

SEQ ID NO: 1603 - RNA, 19 nt, Artificial Sequence
  Synthetic oligonucleotide
uucuucuccccagugagca

SEQ ID NO: 1604 - RNA, 19 nt, Artificial Sequence
  Synthetic oligonucleotide
cuucuccccagugagcauc

SEQ ID NO: 1605 - RNA, 19 nt, Artificial Sequence
  Synthetic oligonucleotide
uucuccccagugagcaucg

SEQ ID NO: 1606 - RNA, 19 nt, Artificial Sequence
  Synthetic oligonucleotide
cuccccagugagcaucgcu

SEQ ID NO: 1607 - RNA, 19 nt, Artificial Sequence
  Synthetic oligonucleotide
cuacagccuuugcaaugcu

SEQ ID NO: 1608 - RNA, 19 nt, Artificial Sequence
  Synthetic oligonucleotide
uuugcaaugcucucccugg

SEQ ID NO: 1609 - RNA, 19 nt, Artificial Sequence
  Synthetic oligonucleotide
ugaaauccuggagggccug

SEQ ID NO: 1610 - RNA, 19 nt, Artificial Sequence
  Synthetic oligonucleotide
gaaauccuggagggccuga

SEQ ID NO: 1611 - RNA, 19 nt, Artificial Sequence
  Synthetic oligonucleotide
aaauccuggagggccugaa

SEQ ID NO: 1612 - RNA, 19 nt, Artificial Sequence
  Synthetic oligonucleotide
auccuggagggccugaauu

SEQ ID NO: 1613 - RNA, 19 nt, Artificial Sequence
  Synthetic oligonucleotide
uccuggagggccugaauuu

SEQ ID NO: 1614 - RNA, 19 nt, Artificial Sequence
  Synthetic oligonucleotide
ccuggagggccugaauuuc

SEQ ID NO: 1615 - RNA, 19 nt, Artificial Sequence
  Synthetic oligonucleotide
uccaugaaggcuuccagga

SEQ ID NO: 1616 - RNA, 19 nt, Artificial Sequence
  Synthetic oligonucleotide
augaaggcuuccaggaacu

SEQ ID NO: 1617 - RNA, 19 nt, Artificial Sequence
  Synthetic oligonucleotide
ugaaggcuuccaggaacuc

SEQ ID NO: 1618 - RNA, 19 nt, Artificial Sequence
  Synthetic oligonucleotide
ccagccagacagccagcuc

SEQ ID NO: 1619 - RNA, 19 nt, Artificial Sequence
  Synthetic oligonucleotide
agccagacagccagcucca

SEQ ID NO: 1620 - RNA, 19 nt, Artificial Sequence
  Synthetic oligonucleotide
ccagacagccagcuccagc

SEQ ID NO: 1621 - RNA, 19 nt, Artificial Sequence
  Synthetic oligonucleotide
cagacagccagcuccagcu

SEQ ID NO: 1622 - RNA, 19 nt, Artificial Sequence
  Synthetic oligonucleotide
gcuaguggauaaguuuuug

SEQ ID NO: 1623 - RNA, 19 nt, Artificial Sequence
  Synthetic oligonucleotide
cuaguggauaaguuuuugg

SEQ ID NO: 1624 - RNA, 19 nt, Artificial Sequence
  Synthetic oligonucleotide
uaguggauaaguuuuugga

SEQ ID NO: 1625 - RNA, 19 nt, Artificial Sequence
  Synthetic oligonucleotide
aguggauaaguuuuuggag

SEQ ID NO: 1626 - RNA, 19 nt, Artificial Sequence
  Synthetic oligonucleotide
guggauaaguuuuuggagg

SEQ ID NO: 1627 - RNA, 19 nt, Artificial Sequence
  Synthetic oligonucleotide
uggauaaguuuuuggagga

SEQ ID NO: 1628 - RNA, 19 nt, Artificial Sequence
  Synthetic oligonucleotide
ggauaaguuuuuggaggau

SEQ ID NO: 1629 - RNA, 19 nt, Artificial Sequence
  Synthetic oligonucleotide
guuguaccacucagaagcc

SEQ ID NO: 1630 - RNA, 19 nt, Artificial Sequence
  Synthetic oligonucleotide
uuguaccacucagaagccu

SEQ ID NO: 1631 - RNA, 19 nt, Artificial Sequence
  Synthetic oligonucleotide
guacucaagggaaaauugu

SEQ ID NO: 1632 - RNA, 19 nt, Artificial Sequence
  Synthetic oligonucleotide
uacucaagggaaaauugug

SEQ ID NO: 1633 - RNA, 19 nt, Artificial Sequence
  Synthetic oligonucleotide
acucaagggaaaauugugg

SEQ ID NO: 1634 - RNA, 19 nt, Artificial Sequence
  Synthetic oligonucleotide
cucaagggaaaauugugga

SEQ ID NO: 1635 - RNA, 19 nt, Artificial Sequence
  Synthetic oligonucleotide
ucaagggaaaauuguggau

SEQ ID NO: 1636 - RNA, 19 nt, Artificial Sequence
  Synthetic oligonucleotide
caagggaaaauuguggauu

SEQ ID NO: 1637 - RNA, 19 nt, Artificial Sequence
  Synthetic oligonucleotide
aagggaaaauuguggauuu

SEQ ID NO: 1638 - RNA, 19 nt, Artificial Sequence
  Synthetic oligonucleotide
agggaaaauuguggauuug

SEQ ID NO: 1639 - RNA, 19 nt, Artificial Sequence
  Synthetic oligonucleotide
gggaaaauuguggauuugg

SEQ ID NO: 1640 - RNA, 19 nt, Artificial Sequence
  Synthetic oligonucleotide
ggaaaauuguggauuuggu

SEQ ID NO: 1641 - RNA, 19 nt, Artificial Sequence
  Synthetic oligonucleotide
gaaaauuguggauuugguc

SEQ ID NO: 1642 - RNA, 19 nt, Artificial Sequence
  Synthetic oligonucleotide
aaaauuguggauuugguca

SEQ ID NO: 1643 - RNA, 19 nt, Artificial Sequence
  Synthetic oligonucleotide
aaauuguggauuuggucaa

SEQ ID NO: 1644 - RNA, 19 nt, Artificial Sequence
  Synthetic oligonucleotide
aauuguggauuuggucaag

SEQ ID NO: 1645 - RNA, 19 nt, Artificial Sequence
  Synthetic oligonucleotide
auuguggauuuggucaagg

SEQ ID NO: 1646 - RNA, 19 nt, Artificial Sequence
  Synthetic oligonucleotide
uuguggauuuggucaagga

SEQ ID NO: 1647 - RNA, 19 nt, Artificial Sequence
  Synthetic oligonucleotide
uguggauuuggucaaggag

SEQ ID NO: 1648 - RNA, 19 nt, Artificial Sequence
  Synthetic oligonucleotide
guggauuuggucaaggagc

SEQ ID NO: 1649 - RNA, 19 nt, Artificial Sequence
  Synthetic oligonucleotide
uggauuuggucaaggagcu

SEQ ID NO: 1650 - RNA, 19 nt, Artificial Sequence
  Synthetic oligonucleotide
ggauuuggucaaggagcuu

SEQ ID NO: 1651 - RNA, 19 nt, Artificial Sequence
  Synthetic oligonucleotide
gauuuggucaaggagcuug

SEQ ID NO: 1652 - RNA, 19 nt, Artificial Sequence
  Synthetic oligonucleotide
auuuggucaaggagcuuga

SEQ ID NO: 1653 - RNA, 19 nt, Artificial Sequence
  Synthetic oligonucleotide
uuuggucaaggagcuugac

SEQ ID NO: 1654 - RNA, 19 nt, Artificial Sequence
  Synthetic oligonucleotide
cacaguuuuugcucuggug

SEQ ID NO: 1655 - RNA, 19 nt, Artificial Sequence
  Synthetic oligonucleotide
acaguuuuugcucugguga

SEQ ID NO: 1656 - RNA, 19 nt, Artificial Sequence
  Synthetic oligonucleotide
caguuuuugcucuggugaa

SEQ ID NO: 1657 - RNA, 19 nt, Artificial Sequence
  Synthetic oligonucleotide
aguuuuugcucuggugaau

SEQ ID NO: 1658 - RNA, 19 nt, Artificial Sequence
  Synthetic oligonucleotide
uuaaaggcaaaugggagag

SEQ ID NO: 1659 - RNA, 19 nt, Artificial Sequence
  Synthetic oligonucleotide
uaaaggcaaaugggagaga

SEQ ID NO: 1660 - RNA, 19 nt, Artificial Sequence
  Synthetic oligonucleotide
aaaggcaaaugggagagac

SEQ ID NO: 1661 - RNA, 19 nt, Artificial Sequence
  Synthetic oligonucleotide
aaggcaaaugggagagacc

SEQ ID NO: 1662 - RNA, 19 nt, Artificial Sequence
  Synthetic oligonucleotide
cgaggaagaggacuuccac

SEQ ID NO: 1663 - RNA, 19 nt, Artificial Sequence
  Synthetic oligonucleotide
gaggaagaggacuuccacg

SEQ ID NO: 1664 - RNA, 19 nt, Artificial Sequence
  Synthetic oligonucleotide
aggaagaggacuuccacgu

SEQ ID NO: 1665 - RNA, 19 nt, Artificial Sequence
  Synthetic oligonucleotide
ggaagaggacuuccacgug

SEQ ID NO: 1666 - RNA, 19 nt, Artificial Sequence
  Synthetic oligonucleotide
aagaggacuuccacgugga

SEQ ID NO: 1667 - RNA, 19 nt, Artificial Sequence
  Synthetic oligonucleotide
agaggacuuccacguggac

SEQ ID NO: 1668 - RNA, 19 nt, Artificial Sequence
  Synthetic oligonucleotide
aggacuuccacguggacca

SEQ ID NO: 1669 - RNA, 19 nt, Artificial Sequence
  Synthetic oligonucleotide
gcguuuaggcauguuuaac

SEQ ID NO: 1670 - RNA, 19 nt, Artificial Sequence
  Synthetic oligonucleotide
cguuuaggcauguuuaaca

SEQ ID NO: 1671 - RNA, 19 nt, Artificial Sequence
  Synthetic oligonucleotide
aagcuguccagcugggugc

SEQ ID NO: 1672 - RNA, 19 nt, Artificial Sequence
  Synthetic oligonucleotide
agcuguccagcugggugcu

SEQ ID NO: 1673 - RNA, 19 nt, Artificial Sequence
  Synthetic oligonucleotide
ggcaaugccaccgccaucu

SEQ ID NO: 1674 - RNA, 19 nt, Artificial Sequence
  Synthetic oligonucleotide
gcaaugccaccgccaucuu

SEQ ID NO: 1675 - RNA, 19 nt, Artificial Sequence
  Synthetic oligonucleotide
ugccaccgccaucuucuuc

SEQ ID NO: 1676 - RNA, 19 nt, Artificial Sequence
  Synthetic oligonucleotide
gccaccgccaucuucuucc

SEQ ID NO: 1677 - RNA, 19 nt, Artificial Sequence
  Synthetic oligonucleotide
ccaccgccaucuucuuccu

SEQ ID NO: 1678 - RNA, 19 nt, Artificial Sequence
  Synthetic oligonucleotide
caccgccaucuucuuccug

SEQ ID NO: 1679 - RNA, 19 nt, Artificial Sequence
  Synthetic oligonucleotide
accgccaucuucuuccugc

SEQ ID NO: 1680 - RNA, 19 nt, Artificial Sequence
  Synthetic oligonucleotide
ccgccaucuucuuccugcc

SEQ ID NO: 1681 - RNA, 19 nt, Artificial Sequence
  Synthetic oligonucleotide
ccaucuucuuccugccuga

SEQ ID NO: 1682 - RNA, 19 nt, Artificial Sequence
  Synthetic oligonucleotide
uucuuccugccugaugagg

SEQ ID NO: 1683 - RNA, 19 nt, Artificial Sequence
  Synthetic oligonucleotide
ucuuccugccugaugaggg

SEQ ID NO: 1684 - RNA, 19 nt, Artificial Sequence
  Synthetic oligonucleotide
cuuccugccugaugagggg

SEQ ID NO: 1685 - RNA, 19 nt, Artificial Sequence
  Synthetic oligonucleotide
uuccugccugaugagggga

SEQ ID NO: 1686 - RNA, 19 nt, Artificial Sequence
  Synthetic oligonucleotide
uccugccugaugaggggaa

SEQ ID NO: 1687 - RNA, 19 nt, Artificial Sequence
  Synthetic oligonucleotide
ccugccugaugaggggaaa

SEQ ID NO: 1688 - RNA, 19 nt, Artificial Sequence
  Synthetic oligonucleotide
acagcaccuggaaaaugaa

SEQ ID NO: 1689 - RNA, 19 nt, Artificial Sequence
  Synthetic oligonucleotide
cagcaccuggaaaaugaac

SEQ ID NO: 1690 - RNA, 19 nt, Artificial Sequence
  Synthetic oligonucleotide
agcaccuggaaaaugaacu

SEQ ID NO: 1691 - RNA, 19 nt, Artificial Sequence
  Synthetic oligonucleotide
gcaccuggaaaaugaacuc

SEQ ID NO: 1692 - RNA, 19 nt, Artificial Sequence
  Synthetic oligonucleotide
caccuggaaaaugaacuca

SEQ ID NO: 1693 - RNA, 19 nt, Artificial Sequence
  Synthetic oligonucleotide
cgauaucaucaccaaguuc

SEQ ID NO: 1694 - RNA, 19 nt, Artificial Sequence
  Synthetic oligonucleotide
gauaucaucaccaaguucc

SEQ ID NO: 1695 - RNA, 19 nt, Artificial Sequence
  Synthetic oligonucleotide
auaucaucaccaaguuccu

SEQ ID NO: 1696 - RNA, 19 nt, Artificial Sequence
  Synthetic oligonucleotide
uaucaucaccaaguuccug

SEQ ID NO: 1697 - RNA, 19 nt, Artificial Sequence
  Synthetic oligonucleotide
aucaucaccaaguuccugg

SEQ ID NO: 1698 - RNA, 19 nt, Artificial Sequence
  Synthetic oligonucleotide
ucaucaccaaguuccugga

SEQ ID NO: 1699 - RNA, 19 nt, Artificial Sequence
  Synthetic oligonucleotide
caucaccaaguuccuggaa

SEQ ID NO: 1700 - RNA, 19 nt, Artificial Sequence
  Synthetic oligonucleotide
aucaccaaguuccuggaaa

SEQ ID NO: 1701 - RNA, 19 nt, Artificial Sequence
  Synthetic oligonucleotide
ucaccaaguuccuggaaaa

SEQ ID NO: 1702 - RNA, 19 nt, Artificial Sequence
  Synthetic oligonucleotide
caccaaguuccuggaaaau

SEQ ID NO: 1703 - RNA, 19 nt, Artificial Sequence
  Synthetic oligonucleotide
uaaggucuucagcaauggg

SEQ ID NO: 1704 - RNA, 19 nt, Artificial Sequence
  Synthetic oligonucleotide
agcaauggggcugaccucu

SEQ ID NO: 1705 - RNA, 19 nt, Artificial Sequence
  Synthetic oligonucleotide
gcaauggggcugaccucuc

SEQ ID NO: 1706 - RNA, 19 nt, Artificial Sequence
  Synthetic oligonucleotide
caauggggcugaccucucc

SEQ ID NO: 1707 - RNA, 19 nt, Artificial Sequence
  Synthetic oligonucleotide
cagaggaggcaccccugaa

SEQ ID NO: 1708 - RNA, 19 nt, Artificial Sequence
  Synthetic oligonucleotide
gaggaggcaccccugaagc

SEQ ID NO: 1709 - RNA, 19 nt, Artificial Sequence
  Synthetic oligonucleotide
cccugaagcucuccaaggc

SEQ ID NO: 1710 - RNA, 19 nt, Artificial Sequence
  Synthetic oligonucleotide
gccgugcauaaggcugugc

SEQ ID NO: 1711 - RNA, 19 nt, Artificial Sequence
  Synthetic oligonucleotide
ccgugcauaaggcugugcu

SEQ ID NO: 1712 - RNA, 19 nt, Artificial Sequence
  Synthetic oligonucleotide
cgugcauaaggcugugcug

SEQ ID NO: 1713 - RNA, 19 nt, Artificial Sequence
  Synthetic oligonucleotide
gugcauaaggcugugcuga

SEQ ID NO: 1714 - RNA, 19 nt, Artificial Sequence
  Synthetic oligonucleotide
ugcauaaggcugugcugac

SEQ ID NO: 1715 - RNA, 19 nt, Artificial Sequence
  Synthetic oligonucleotide
gcauaaggcugugcugacc

SEQ ID NO: 1716 - RNA, 19 nt, Artificial Sequence
  Synthetic oligonucleotide
cauaaggcugugcugacca

SEQ ID NO: 1717 - RNA, 19 nt, Artificial Sequence
  Synthetic oligonucleotide
auaaggcugugcugaccau

SEQ ID NO: 1718 - RNA, 19 nt, Artificial Sequence
  Synthetic oligonucleotide
uaaggcugugcugaccauc

SEQ ID NO: 1719 - RNA, 19 nt, Artificial Sequence
  Synthetic oligonucleotide
ggacugaagcugcuggggc

SEQ ID NO: 1720 - RNA, 19 nt, Artificial Sequence
  Synthetic oligonucleotide
gacugaagcugcuggggcc

SEQ ID NO: 1721 - RNA, 19 nt, Artificial Sequence
  Synthetic oligonucleotide
acugaagcugcuggggcca

SEQ ID NO: 1722 - RNA, 19 nt, Artificial Sequence
  Synthetic oligonucleotide
cugaagcugcuggggccau

SEQ ID NO: 1723 - RNA, 19 nt, Artificial Sequence
  Synthetic oligonucleotide
ugaagcugcuggggccaug

SEQ ID NO: 1724 - RNA, 19 nt, Artificial Sequence
  Synthetic oligonucleotide
gaagcugcuggggccaugu

SEQ ID NO: 1725 - RNA, 19 nt, Artificial Sequence
  Synthetic oligonucleotide
gggccauguuuuuagaggc

SEQ ID NO: 1726 - RNA, 19 nt, Artificial Sequence
  Synthetic oligonucleotide
ggccauguuuuuagaggcc

SEQ ID NO: 1727 - RNA, 19 nt, Artificial Sequence
  Synthetic oligonucleotide
gccauguuuuuagaggcca

SEQ ID NO: 1728 - RNA, 19 nt, Artificial Sequence
  Synthetic oligonucleotide
ccauguuuuuagaggccau

SEQ ID NO: 1729 - RNA, 19 nt, Artificial Sequence
  Synthetic oligonucleotide
cauguuuuuagaggccaua

SEQ ID NO: 1730 - RNA, 19 nt, Artificial Sequence
  Synthetic oligonucleotide
auguuuuuagaggccauac

SEQ ID NO: 1731 - RNA, 19 nt, Artificial Sequence
  Synthetic oligonucleotide
uguuuuuagaggccauacc

SEQ ID NO: 1732 - RNA, 19 nt, Artificial Sequence
  Synthetic oligonucleotide
guuuuuagaggccauaccc

SEQ ID NO: 1733 - RNA, 19 nt, Artificial Sequence
  Synthetic oligonucleotide
uuuuuagaggccauaccca

SEQ ID NO: 1734 - RNA, 19 nt, Artificial Sequence
  Synthetic oligonucleotide
uuuuagaggccauacccau

SEQ ID NO: 1735 - RNA, 19 nt, Artificial Sequence
  Synthetic oligonucleotide
uuuagaggccauacccaug

SEQ ID NO: 1736 - RNA, 19 nt, Artificial Sequence
  Synthetic oligonucleotide
uuagaggccauacccaugu

SEQ ID NO: 1737 - RNA, 19 nt, Artificial Sequence
  Synthetic oligonucleotide
aaguucaacaaacccuuug

SEQ ID NO: 1738 - RNA, 19 nt, Artificial Sequence
  Synthetic oligonucleotide
aguucaacaaacccuuugu

SEQ ID NO: 1739 - RNA, 19 nt, Artificial Sequence
  Synthetic oligonucleotide
guucaacaaacccuuuguc

SEQ ID NO: 1740 - RNA, 19 nt, Artificial Sequence
  Synthetic oligonucleotide
uucaacaaacccuuugucu

SEQ ID NO: 1741 - RNA, 19 nt, Artificial Sequence
  Synthetic oligonucleotide
ucaacaaacccuuugucuu

SEQ ID NO: 1742 - RNA, 19 nt, Artificial Sequence
  Synthetic oligonucleotide
caacaaacccuuugucuuc

SEQ ID NO: 1743 - RNA, 19 nt, Artificial Sequence
  Synthetic oligonucleotide
aacaaacccuuugucuucu

SEQ ID NO: 1744 - RNA, 19 nt, Artificial Sequence
  Synthetic oligonucleotide
acaaacccuuugucuucuu

SEQ ID NO: 1745 - RNA, 19 nt, Artificial Sequence
  Synthetic oligonucleotide
caaacccuuugucuucuua

SEQ ID NO: 1746 - RNA, 19 nt, Artificial Sequence
  Synthetic oligonucleotide
aaaauaccaagucuccccu

SEQ ID NO: 1747 - RNA, 19 nt, Artificial Sequence
  Synthetic oligonucleotide
aaauaccaagucuccccuc

SEQ ID NO: 1748 - RNA, 19 nt, Artificial Sequence
  Synthetic oligonucleotide
aauaccaagucuccccucu

SEQ ID NO: 1749 - RNA, 19 nt, Artificial Sequence
  Synthetic oligonucleotide
auaccaagucuccccucuu

SEQ ID NO: 1750 - RNA, 19 nt, Artificial Sequence
  Synthetic oligonucleotide
uaccaagucuccccucuuc

SEQ ID NO: 1751 - RNA, 19 nt, Artificial Sequence
  Synthetic oligonucleotide
accaagucuccccucuuca

SEQ ID NO: 1752 - RNA, 19 nt, Artificial Sequence
  Synthetic oligonucleotide
ccaagucuccccucuucau

SEQ ID NO: 1753 - RNA, 19 nt, Artificial Sequence
  Synthetic oligonucleotide
caagucuccccucuucaug

SEQ ID NO: 1754 - RNA, 19 nt, Artificial Sequence
  Synthetic oligonucleotide
aagucuccccucuucaugg

SEQ ID NO: 1755 - RNA, 19 nt, Artificial Sequence
  Synthetic oligonucleotide
gucuccccucuucauggga

SEQ ID NO: 1756 - RNA, 19 nt, Artificial Sequence
  Synthetic oligonucleotide
cuccccucuucaugggaaa

SEQ ID NO: 1757 - RNA, 19 nt, Artificial Sequence
  Synthetic oligonucleotide
uccccucuucaugggaaaa

SEQ ID NO: 1758 - RNA, 19 nt, Artificial Sequence
  Synthetic oligonucleotide
ccccucuucaugggaaaag

SEQ ID NO: 1759 - RNA, 19 nt, Artificial Sequence
  Synthetic oligonucleotide
cccucuucaugggaaaagu

SEQ ID NO: 1760 - RNA, 19 nt, Artificial Sequence
  Synthetic oligonucleotide
ccucuucaugggaaaagug

SEQ ID NO: 1761 - RNA, 19 nt, Artificial Sequence
  Synthetic oligonucleotide
cucuucaugggaaaagugg

SEQ ID NO: 1762 - RNA, 19 nt, Artificial Sequence
  Synthetic oligonucleotide
ucuucaugggaaaaguggu

SEQ ID NO: 1763 - RNA, 19 nt, Artificial Sequence
  Synthetic oligonucleotide
cuucaugggaaaaguggug

SEQ ID NO: 1764 - RNA, 19 nt, Artificial Sequence
  Synthetic oligonucleotide
uucaugggaaaagugguga

SEQ ID NO: 1765 - RNA, 19 nt, Artificial Sequence
  Synthetic oligonucleotide
ucaugggaaaaguggugaa

SEQ ID NO: 1766 - RNA, 19 nt, Artificial Sequence
  Synthetic oligonucleotide
caugggaaaaguggugaau

SEQ ID NO: 1767 - RNA, 19 nt, Artificial Sequence
  Synthetic oligonucleotide
augggaaaaguggugaauc

SEQ ID NO: 1768 - RNA, 19 nt, Artificial Sequence
  Synthetic oligonucleotide
ugggaaaaguggugaaucc

SEQ ID NO: 1769 - RNA, 19 nt, Artificial Sequence
  Synthetic oligonucleotide
gggaaaaguggugaauccc

SEQ ID NO: 1770 - RNA, 19 nt, Artificial Sequence
  Synthetic oligonucleotide
ggaaaaguggugaauccca

SEQ ID NO: 1771 - RNA, 19 nt, Artificial Sequence
  Synthetic oligonucleotide
gaaaaguggugaaucccac

SEQ ID NO: 1772 - RNA, 19 nt, Artificial Sequence
  Synthetic oligonucleotide
aaaaguggugaaucccacc

SEQ ID NO: 1773 - RNA, 19 nt, Artificial Sequence
  Synthetic oligonucleotide
uucgauaguucaaaauggu

SEQ ID NO: 1774 - RNA, 19 nt, Artificial Sequence
  Synthetic oligonucleotide
uucaaaauggugaaauuag

SEQ ID NO: 1775 - RNA, 19 nt, Artificial Sequence
  Synthetic oligonucleotide
aguugguaugauguucaag

SEQ ID NO: 1776 - RNA, 19 nt, Artificial Sequence
  Synthetic oligonucleotide
uugguaugauguucaaguu

SEQ ID NO: 1777 - RNA, 19 nt, Artificial Sequence
  Synthetic oligonucleotide
ugguaugauguucaaguua

SEQ ID NO: 1778 - RNA, 19 nt, Artificial Sequence
  Synthetic oligonucleotide
guaugauguucaaguuaga

SEQ ID NO: 1779 - RNA, 19 nt, Artificial Sequence
  Synthetic oligonucleotide
ugauguucaaguuagauaa

SEQ ID NO: 1780 - RNA, 19 nt, Artificial Sequence
  Synthetic oligonucleotide
uucaaguuagauaacaaaa

SEQ ID NO: 1781 - RNA, 19 nt, Artificial Sequence
  Synthetic oligonucleotide
ucaaguuagauaacaaaau

SEQ ID NO: 1782 - RNA, 19 nt, Artificial Sequence
  Synthetic oligonucleotide
caaguuagauaacaaaaug

SEQ ID NO: 1783 - DNA, 25 bp, Artificial Sequence
  Synthetic oligonucleotide
gcguuuaggcauguuuaacauccag

SEQ ID NO: 1784 - DNA, 25 bp, Artificial Sequence
  Synthetic oligonucleotide
cguuuaggcauguuuaacauccagc

SEQ ID NO: 1785 - DNA, 25 bp, Artificial Sequence
  Synthetic oligonucleotide
ggccauguuuuuagaggccauaccc

SEQ ID NO: 1786 - DNA, 25 bp, Artificial Sequence
  Synthetic oligonucleotide
acccuuugucuucuuaaugauugaa

SEQ ID NO: 1787 - DNA, 25 bp, Artificial Sequence
  Synthetic oligonucleotide
cccuuugucuucuuaaugauugaac

SEQ ID NO: 1788 - DNA, 25 bp, Artificial Sequence
  Synthetic oligonucleotide
ccuuugucuucuuaaugauugaaca

SEQ ID NO: 1789 - DNA, 25 bp, Artificial Sequence
  Synthetic oligonucleotide
cuuugucuucuuaaugauugaacaa

SEQ ID NO: 1790 - DNA, 25 bp, Artificial Sequence
  Synthetic oligonucleotide
uuugucuucuuaaugauugaacaaa

SEQ ID NO: 1791 - DNA, 25 bp, Artificial Sequence
  Synthetic oligonucleotide
uugucuucuuaaugauugaacaaaa

SEQ ID NO: 1792 - DNA, 25 bp, Artificial Sequence
  Synthetic oligonucleotide
ugucuucuuaaugauugaacaaaat

SEQ ID NO: 1793 - DNA, 25 bp, Artificial Sequence
  Synthetic oligonucleotide
gucuucuuaaugauugaacaaaata

SEQ ID NO: 1794 - DNA, 25 bp, Artificial Sequence
  Synthetic oligonucleotide
ucuucuuaaugauugaacaaaauac

SEQ ID NO: 1795 - DNA, 25 bp, Artificial Sequence
  Synthetic oligonucleotide
cuucuuaaugauugaacaaaauacc

SEQ ID NO: 1796 - DNA, 25 bp, Artificial Sequence
  Synthetic oligonucleotide
uucuuaaugauugaacaaaauacca

SEQ ID NO: 1797 - DNA, 25 bp, Artificial Sequence
  Synthetic oligonucleotide
ucuuaaugauugaacaaaauaccaa

SEQ ID NO: 1798 - DNA, 25 bp, Artificial Sequence
  Synthetic oligonucleotide
cuuaaugauugaacaaaauaccaag

SEQ ID NO: 1799 - DNA, 25 bp, Artificial Sequence
  Synthetic oligonucleotide
uuaaugauugaacaaaauaccaagt

SEQ ID NO: 1800 - DNA, 25 bp, Artificial Sequence
  Synthetic oligonucleotide
uaaugauugaacaaaauaccaagtc

SEQ ID NO: 1801 - DNA, 25 bp, Artificial Sequence
  Synthetic oligonucleotide
aaugauugaacaaaauaccaaguct

SEQ ID NO: 1802 - DNA, 25 bp, Artificial Sequence
  Synthetic oligonucleotide
augauugaacaaaauaccaaguctc

SEQ ID NO: 1803 - DNA, 25 bp, Artificial Sequence
  Synthetic oligonucleotide
ugauugaacaaaauaccaagucucc

SEQ ID NO: 1804 - DNA, 25 bp, Artificial Sequence
  Synthetic oligonucleotide
gauugaacaaaauaccaagucuccc

SEQ ID NO: 1805 - DNA, 25 bp, Artificial Sequence
  Synthetic oligonucleotide
auugaacaaaauaccaagucucccc

SEQ ID NO: 1806 - DNA, 25 bp, Artificial Sequence
  Synthetic oligonucleotide
uugaacaaaauaccaagucucccct

SEQ ID NO: 1807 - DNA, 25 bp, Artificial Sequence
  Synthetic oligonucleotide
ugaacaaaauaccaagucucccctc

SEQ ID NO: 1808 - DNA, 25 bp, Artificial Sequence
  Synthetic oligonucleotide
gaacaaaauaccaagucuccccuct

SEQ ID NO: 1809 - DNA, 25 bp, Artificial Sequence
  Synthetic oligonucleotide
aacaaaauaccaagucuccccuctt

SEQ ID NO: 1810 - DNA, 25 bp, Artificial Sequence
  Synthetic oligonucleotide
acaaaauaccaagucuccccucutc

SEQ ID NO: 1811 - DNA, 25 bp, Artificial Sequence
  Synthetic oligonucleotide
caaaauaccaagucuccccucuuca

SEQ ID NO: 1812 - DNA, 25 bp, Artificial Sequence
  Synthetic oligonucleotide
aaaauaccaagucuccccucuucat

SEQ ID NO: 1813 - DNA, 25 bp, Artificial Sequence
  Synthetic oligonucleotide
aaauaccaagucuccccucuucatg

SEQ ID NO: 1814 - RNA, 27 nt, Artificial Sequence
  Synthetic oligonucleotide
cuggauguuaaacaugccuaaacgcuu

SEQ ID NO: 1815 - RNA, 27 nt, Artificial Sequence
  Synthetic oligonucleotide
gcuggauguuaaacaugccuaaacgcu

SEQ ID NO: 1816 - RNA, 27 nt, Artificial Sequence
  Synthetic oligonucleotide
ggguauggccucuaaaaacauggcccc

SEQ ID NO: 1817 - RNA, 27 nt, Artificial Sequence
  Synthetic oligonucleotide
uucaaucauuaagaagacaaaggguuu

SEQ ID NO: 1818 - RNA, 27 nt, Artificial Sequence
  Synthetic oligonucleotide
guucaaucauuaagaagacaaaggguu

SEQ ID NO: 1819 - RNA, 27 nt, Artificial Sequence
  Synthetic oligonucleotide
uguucaaucauuaagaagacaaagggu

SEQ ID NO: 1820 - RNA, 27 nt, Artificial Sequence
  Synthetic oligonucleotide
uuguucaaucauuaagaagacaaaggg

SEQ ID NO: 1821 - RNA, 27 nt, Artificial Sequence
  Synthetic oligonucleotide
uuuguucaaucauuaagaagacaaagg

SEQ ID NO: 1822 - RNA, 27 nt, Artificial Sequence
  Synthetic oligonucleotide
uuuuguucaaucauuaagaagacaaag

SEQ ID NO: 1823 - RNA, 27 nt, Artificial Sequence
  Synthetic oligonucleotide
auuuuguucaaucauuaagaagacaaa

SEQ ID NO: 1824 - RNA, 27 nt, Artificial Sequence
  Synthetic oligonucleotide
uauuuuguucaaucauuaagaagacaa

SEQ ID NO: 1825 - RNA, 27 nt, Artificial Sequence
  Synthetic oligonucleotide
guauuuuguucaaucauuaagaagaca

SEQ ID NO: 1826 - RNA, 27 nt, Artificial Sequence
  Synthetic oligonucleotide
gguauuuuguucaaucauuaagaagac

SEQ ID NO: 1827 - RNA, 27 nt, Artificial Sequence
  Synthetic oligonucleotide
ugguauuuuguucaaucauuaagaaga

SEQ ID NO: 1828 - RNA, 27 nt, Artificial Sequence
  Synthetic oligonucleotide
uugguauuuuguucaaucauuaagaag

SEQ ID NO: 1829 - RNA, 27 nt, Artificial Sequence
  Synthetic oligonucleotide
cuugguauuuuguucaaucauuaagaa

SEQ ID NO: 1830 - RNA, 27 nt, Artificial Sequence
  Synthetic oligonucleotide
acuugguauuuuguucaaucauuaaga

SEQ ID NO: 1831 - RNA, 27 nt, Artificial Sequence
  Synthetic oligonucleotide
gacuugguauuuuguucaaucauuaag

SEQ ID NO: 1832 - RNA, 27 nt, Artificial Sequence
  Synthetic oligonucleotide
agacuugguauuuuguucaaucauuaa

SEQ ID NO: 1833 - RNA, 27 nt, Artificial Sequence
  Synthetic oligonucleotide
gagacuugguauuuuguucaaucauua

SEQ ID NO: 1834 - RNA, 27 nt, Artificial Sequence
  Synthetic oligonucleotide
ggagacuugguauuuuguucaaucauu

SEQ ID NO: 1835 - RNA, 27 nt, Artificial Sequence
  Synthetic oligonucleotide
gggagacuugguauuuuguucaaucau

SEQ ID NO: 1836 - RNA, 27 nt, Artificial Sequence
  Synthetic oligonucleotide
ggggagacuugguauuuuguucaauca

SEQ ID NO: 1837 - RNA, 27 nt, Artificial Sequence
  Synthetic oligonucleotide
aggggagacuugguauuuuguucaauc

SEQ ID NO: 1838 - RNA, 27 nt, Artificial Sequence
  Synthetic oligonucleotide
gaggggagacuugguauuuuguucaau

SEQ ID NO: 1839 - RNA, 27 nt, Artificial Sequence
  Synthetic oligonucleotide
agaggggagacuugguauuuuguucaa

SEQ ID NO: 1840 - RNA, 27 nt, Artificial Sequence
  Synthetic oligonucleotide
aagaggggagacuugguauuuuguuca

SEQ ID NO: 1841 - RNA, 27 nt, Artificial Sequence
  Synthetic oligonucleotide
gaagaggggagacuugguauuuuguuc

SEQ ID NO: 1842 - RNA, 27 nt, Artificial Sequence
  Synthetic oligonucleotide
ugaagaggggagacuugguauuuuguu

SEQ ID NO: 1843 - RNA, 27 nt, Artificial Sequence
  Synthetic oligonucleotide
augaagaggggagacuugguauuuugu

SEQ ID NO: 1844 - RNA, 27 nt, Artificial Sequence
  Synthetic oligonucleotide
caugaagaggggagacuugguauuuug

SEQ ID NO: 1845 - DNA, 27 bp, Artificial Sequence
  Synthetic oligonucleotide
aagcgtttaggcatgtttaacatccag

SEQ ID NO: 1846 - DNA, 27 bp, Artificial Sequence
  Synthetic oligonucleotide
agcgtttaggcatgtttaacatccagc

SEQ ID NO: 1847 - DNA, 27 bp, Artificial Sequence
  Synthetic oligonucleotide
ggggccatgtttttagaggccataccc

SEQ ID NO: 1848 - DNA, 27 bp, Artificial Sequence
  Synthetic oligonucleotide
aaaccctttgtcttcttaatgattgaa

SEQ ID NO: 1849 - DNA, 27 bp, Artificial Sequence
  Synthetic oligonucleotide
aaccctttgtcttcttaatgattgaac

SEQ ID NO: 1850 - DNA, 27 bp, Artificial Sequence
  Synthetic oligonucleotide
accctttgtcttcttaatgattgaaca

SEQ ID NO: 1851 - DNA, 27 bp, Artificial Sequence
  Synthetic oligonucleotide
ccctttgtcttcttaatgattgaacaa

SEQ ID NO: 1852 - DNA, 27 bp, Artificial Sequence
  Synthetic oligonucleotide
cctttgtcttcttaatgattgaacaaa

SEQ ID NO: 1853 - DNA, 27 bp, Artificial Sequence
  Synthetic oligonucleotide
ctttgtcttcttaatgattgaacaaaa

SEQ ID NO: 1854 - DNA, 27 bp, Artificial Sequence
  Synthetic oligonucleotide
tttgtcttcttaatgattgaacaaaat

SEQ ID NO: 1855 - DNA, 27 bp, Artificial Sequence
  Synthetic oligonucleotide
ttgtcttcttaatgattgaacaaaata

SEQ ID NO: 1856 - DNA, 27 bp, Artificial Sequence
  Synthetic oligonucleotide
tgtcttcttaatgattgaacaaaatac

SEQ ID NO: 1857 - DNA, 27 bp, Artificial Sequence
  Synthetic oligonucleotide
gtcttcttaatgattgaacaaaatacc

SEQ ID NO: 1858 - DNA, 27 bp, Artificial Sequence
  Synthetic oligonucleotide
tcttcttaatgattgaacaaaatacca

SEQ ID NO: 1859 - DNA, 27 bp, Artificial Sequence
  Synthetic oligonucleotide
cttcttaatgattgaacaaaataccaa

SEQ ID NO: 1860 - DNA, 27 bp, Artificial Sequence
  Synthetic oligonucleotide
ttcttaatgattgaacaaaataccaag

SEQ ID NO: 1861 - DNA, 27 bp, Artificial Sequence
  Synthetic oligonucleotide
tcttaatgattgaacaaaataccaagt

SEQ ID NO: 1862 - DNA, 27 bp, Artificial Sequence
  Synthetic oligonucleotide
cttaatgattgaacaaaataccaagtc

SEQ ID NO: 1863 - DNA, 27 bp, Artificial Sequence
  Synthetic oligonucleotide
ttaatgattgaacaaaataccaagtct

SEQ ID NO: 1864 - DNA, 27 bp, Artificial Sequence
  Synthetic oligonucleotide
taatgattgaacaaaataccaagtctc

SEQ ID NO: 1865 - DNA, 27 bp, Artificial Sequence
  Synthetic oligonucleotide
aatgattgaacaaaataccaagtctcc

SEQ ID NO: 1866 - DNA, 27 bp, Artificial Sequence
  Synthetic oligonucleotide
atgattgaacaaaataccaagtctccc

SEQ ID NO: 1867 - DNA, 27 bp, Artificial Sequence
  Synthetic oligonucleotide
tgattgaacaaaataccaagtctcccc

SEQ ID NO: 1868 - DNA, 27 bp, Artificial Sequence
  Synthetic oligonucleotide
gattgaacaaaataccaagtctcccct

SEQ ID NO: 1869 - DNA, 27 bp, Artificial Sequence
  Synthetic oligonucleotide
attgaacaaaataccaagtctcccctc

SEQ ID NO: 1870 - DNA, 27 bp, Artificial Sequence
  Synthetic oligonucleotide
ttgaacaaaataccaagtctcccctct

SEQ ID NO: 1871 - DNA, 27 bp, Artificial Sequence
  Synthetic oligonucleotide
tgaacaaaataccaagtctcccctctt

SEQ ID NO: 1872 - DNA, 27 bp, Artificial Sequence
  Synthetic oligonucleotide
gaacaaaataccaagtctcccctcttc

SEQ ID NO: 1873 - DNA, 27 bp, Artificial Sequence
  Synthetic oligonucleotide
aacaaaataccaagtctcccctcttca

SEQ ID NO: 1874 - DNA, 27 bp, Artificial Sequence
  Synthetic oligonucleotide
acaaaataccaagtctcccctcttcat

SEQ ID NO: 1875 - DNA, 27 bp, Artificial Sequence
  Synthetic oligonucleotide
caaaataccaagtctcccctcttcatg

SEQ ID NO: 1876 - RNA, 25 nt, Artificial Sequence
  Synthetic oligonucleotide
gcguuuaggcauguuuaacauccag

SEQ ID NO: 1877 - RNA, 25 nt, Artificial Sequence
  Synthetic oligonucleotide
cguuuaggcauguuuaacauccagc

SEQ ID NO: 1878 - RNA, 25 nt, Artificial Sequence
  Synthetic oligonucleotide
ggccauguuuuuagaggccauaccc

SEQ ID NO: 1879 - RNA, 25 nt, Artificial Sequence
  Synthetic oligonucleotide
acccuuugucuucuuaaugauugaa

SEQ ID NO: 1880 - RNA, 25 nt, Artificial Sequence
  Synthetic oligonucleotide
cccuuugucuucuuaaugauugaac

SEQ ID NO: 1881 - RNA, 25 nt, Artificial Sequence
  Synthetic oligonucleotide
ccuuugucuucuuaaugauugaaca

SEQ ID NO: 1882 - RNA, 25 nt, Artificial Sequence
  Synthetic oligonucleotide
cuuugucuucuuaaugauugaacaa

SEQ ID NO: 1883 - RNA, 25 nt, Artificial Sequence
  Synthetic oligonucleotide
uuugucuucuuaaugauugaacaaa

SEQ ID NO: 1884 - RNA, 25 nt, Artificial Sequence
  Synthetic oligonucleotide
uugucuucuuaaugauugaacaaaa

SEQ ID NO: 1885 - RNA, 25 nt, Artificial Sequence
  Synthetic oligonucleotide
ugucuucuuaaugauugaacaaaau

SEQ ID NO: 1886 - RNA, 25 nt, Artificial Sequence
  Synthetic oligonucleotide
gucuucuuaaugauugaacaaaaua

SEQ ID NO: 1887 - RNA, 25 nt, Artificial Sequence
  Synthetic oligonucleotide
ucuucuuaaugauugaacaaaauac

SEQ ID NO: 1888 - RNA, 25 nt, Artificial Sequence
  Synthetic oligonucleotide
cuucuuaaugauugaacaaaauacc

SEQ ID NO: 1889 - RNA, 25 nt, Artificial Sequence
  Synthetic oligonucleotide
uucuuaaugauugaacaaaauacca

SEQ ID NO: 1890 - RNA, 25 nt, Artificial Sequence
  Synthetic oligonucleotide
ucuuaaugauugaacaaaauaccaa

SEQ ID NO: 1891 - RNA, 25 nt, Artificial Sequence
  Synthetic oligonucleotide
cuuaaugauugaacaaaauaccaag

SEQ ID NO: 1892 - RNA, 25 nt, Artificial Sequence
  Synthetic oligonucleotide
uuaaugauugaacaaaauaccaagu

SEQ ID NO: 1893 - RNA, 25 nt, Artificial Sequence
  Synthetic oligonucleotide
uaaugauugaacaaaauaccaaguc

SEQ ID NO: 1894 - RNA, 25 nt, Artificial Sequence
  Synthetic oligonucleotide
aaugauugaacaaaauaccaagucu

SEQ ID NO: 1895 - RNA, 25 nt, Artificial Sequence
  Synthetic oligonucleotide
augauugaacaaaauaccaagucuc

SEQ ID NO: 1896 - RNA, 25 nt, Artificial Sequence
  Synthetic oligonucleotide
ugauugaacaaaauaccaagucucc

SEQ ID NO: 1897 - RNA, 25 nt, Artificial Sequence
  Synthetic oligonucleotide
gauugaacaaaauaccaagucuccc

SEQ ID NO: 1898 - RNA, 25 nt, Artificial Sequence
  Synthetic oligonucleotide
auugaacaaaauaccaagucucccc

SEQ ID NO: 1899 - RNA, 25 nt, Artificial Sequence
  Synthetic oligonucleotide
uugaacaaaauaccaagucuccccu

SEQ ID NO: 1900 - RNA, 25 nt, Artificial Sequence
  Synthetic oligonucleotide
ugaacaaaauaccaagucuccccuc

SEQ ID NO: 1901 - RNA, 25 nt, Artificial Sequence
  Synthetic oligonucleotide
gaacaaaauaccaagucuccccucu

SEQ ID NO: 1902 - RNA, 25 nt, Artificial Sequence
  Synthetic oligonucleotide
aacaaaauaccaagucuccccucuu

SEQ ID NO: 1903 - RNA, 25 nt, Artificial Sequence
  Synthetic oligonucleotide
acaaaauaccaagucuccccucuuc

SEQ ID NO: 1904 - RNA, 25 nt, Artificial Sequence
  Synthetic oligonucleotide
caaaauaccaagucuccccucuuca

SEQ ID NO: 1905 - RNA, 25 nt, Artificial Sequence
  Synthetic oligonucleotide
aaaauaccaagucuccccucuucau

SEQ ID NO: 1906 - RNA, 25 nt, Artificial Sequence
  Synthetic oligonucleotide
aaauaccaagucuccccucuucaug

SEQ ID NO: 1907 - RNA, 21 nt, Artificial Sequence
  Synthetic oligonucleotide
aagcguuuaggcauguuuaac

SEQ ID NO: 1908 - RNA, 21 nt, Artificial Sequence
  Synthetic oligonucleotide
agcguuuaggcauguuuaaca

SEQ ID NO: 1909 - RNA, 21 nt, Artificial Sequence
  Synthetic oligonucleotide
ggggccauguuuuuagaggcc

SEQ ID NO: 1910 - RNA, 21 nt, Artificial Sequence
  Synthetic oligonucleotide
aaacccuuugucuucuuaaug

SEQ ID NO: 1911 - RNA, 21 nt, Artificial Sequence
  Synthetic oligonucleotide
aacccuuugucuucuuaauga

SEQ ID NO: 1912 - RNA, 21 nt, Artificial Sequence
  Synthetic oligonucleotide
acccuuugucuucuuaaugau

SEQ ID NO: 1913 - RNA, 21 nt, Artificial Sequence
  Synthetic oligonucleotide
cccuuugucuucuuaaugauu

SEQ ID NO: 1914 - RNA, 21 nt, Artificial Sequence
  Synthetic oligonucleotide
ccuuugucuucuuaaugauug

SEQ ID NO: 1915 - RNA, 21 nt, Artificial Sequence
  Synthetic oligonucleotide
cuuugucuucuuaaugauuga

SEQ ID NO: 1916 - RNA, 21 nt, Artificial Sequence
  Synthetic oligonucleotide
uuugucuucuuaaugauugaa

SEQ ID NO: 1917 - RNA, 21 nt, Artificial Sequence
  Synthetic oligonucleotide
uugucuucuuaaugauugaac

SEQ ID NO: 1918 - RNA, 21 nt, Artificial Sequence
  Synthetic oligonucleotide
ugucuucuuaaugauugaaca

SEQ ID NO: 1919 - RNA, 21 nt, Artificial Sequence
  Synthetic oligonucleotide
gucuucuuaaugauugaacaa

SEQ ID NO: 1920 - RNA, 21 nt, Artificial Sequence
  Synthetic oligonucleotide
ucuucuuaaugauugaacaaa

SEQ ID NO: 1921 - RNA, 21 nt, Artificial Sequence
  Synthetic oligonucleotide
cuucuuaaugauugaacaaaa

SEQ ID NO: 1922 - RNA, 21 nt, Artificial Sequence
  Synthetic oligonucleotide
uucuuaaugauugaacaaaau

SEQ ID NO: 1923 - RNA, 21 nt, Artificial Sequence
  Synthetic oligonucleotide
ucuuaaugauugaacaaaaua

SEQ ID NO: 1924 - RNA, 21 nt, Artificial Sequence
  Synthetic oligonucleotide
cuuaaugauugaacaaaauac

SEQ ID NO: 1925 - RNA, 21 nt, Artificial Sequence
  Synthetic oligonucleotide
uuaaugauugaacaaaauacc

SEQ ID NO: 1926 - RNA, 21 nt, Artificial Sequence
  Synthetic oligonucleotide
uaaugauugaacaaaauacca

SEQ ID NO: 1927 - RNA, 21 nt, Artificial Sequence
  Synthetic oligonucleotide
aaugauugaacaaaauaccaa

SEQ ID NO: 1928 - RNA, 21 nt, Artificial Sequence
  Synthetic oligonucleotide
augauugaacaaaauaccaag

SEQ ID NO: 1929 - RNA, 21 nt, Artificial Sequence
  Synthetic oligonucleotide
ugauugaacaaaauaccaagu

SEQ ID NO: 1930 - RNA, 21 nt, Artificial Sequence
  Synthetic oligonucleotide
gauugaacaaaauaccaaguc

SEQ ID NO: 1931 - RNA, 21 nt, Artificial Sequence
  Synthetic oligonucleotide
auugaacaaaauaccaagucu

SEQ ID NO: 1932 - RNA, 21 nt, Artificial Sequence
  Synthetic oligonucleotide
uugaacaaaauaccaagucuc

SEQ ID NO: 1933 - RNA, 21 nt, Artificial Sequence
  Synthetic oligonucleotide
ugaacaaaauaccaagucucc

SEQ ID NO: 1934 - RNA, 21 nt, Artificial Sequence
  Synthetic oligonucleotide
gaacaaaauaccaagucuccc

SEQ ID NO: 1935 - RNA, 21 nt, Artificial Sequence
  Synthetic oligonucleotide
aacaaaauaccaagucucccc

SEQ ID NO: 1936 - RNA, 21 nt, Artificial Sequence
  Synthetic oligonucleotide
acaaaauaccaagucuccccu

SEQ ID NO: 1937 - RNA, 21 nt, Artificial Sequence
  Synthetic oligonucleotide
caaaauaccaagucuccccuc

SEQ ID NO: 1938 - RNA, 27 nt, Artificial Sequence
  Synthetic oligonucleotide
aagcguuuaggcauguuuaacauccag

SEQ ID NO: 1939 - RNA, 27 nt, Artificial Sequence
  Synthetic oligonucleotide
agcguuuaggcauguuuaacauccagc

SEQ ID NO: 1940 - RNA, 27 nt, Artificial Sequence
  Synthetic oligonucleotide
ggggccauguuuuuagaggccauaccc

SEQ ID NO: 1941 - RNA, 27 nt, Artificial Sequence
  Synthetic oligonucleotide
aaacccuuugucuucuuaaugauugaa

SEQ ID NO: 1942 - RNA, 27 nt, Artificial Sequence
  Synthetic oligonucleotide
aacccuuugucuucuuaaugauugaac

SEQ ID NO: 1943 - RNA, 27 nt, Artificial Sequence
  Synthetic oligonucleotide
acccuuugucuucuuaaugauugaaca

SEQ ID NO: 1944 - RNA, 27 nt, Artificial Sequence
  Synthetic oligonucleotide
cccuuugucuucuuaaugauugaacaa

SEQ ID NO: 1945 - RNA, 27 nt, Artificial Sequence
  Synthetic oligonucleotide
ccuuugucuucuuaaugauugaacaaa

SEQ ID NO: 1946 - RNA, 27 nt, Artificial Sequence
  Synthetic oligonucleotide
cuuugucuucuuaaugauugaacaaaa

SEQ ID NO: 1947 - RNA, 27 nt, Artificial Sequence
  Synthetic oligonucleotide
uuugucuucuuaaugauugaacaaaau

SEQ ID NO: 1948 - RNA, 27 nt, Artificial Sequence
  Synthetic oligonucleotide
uugucuucuuaaugauugaacaaaaua

SEQ ID NO: 1949 - RNA, 27 nt, Artificial Sequence
  Synthetic oligonucleotide
ugucuucuuaaugauugaacaaaauac

SEQ ID NO: 1950 - RNA, 27 nt, Artificial Sequence
  Synthetic oligonucleotide
gucuucuuaaugauugaacaaaauacc

SEQ ID NO: 1951 - RNA, 27 nt, Artificial Sequence
  Synthetic oligonucleotide
ucuucuuaaugauugaacaaaauacca

SEQ ID NO: 1952 - RNA, 27 nt, Artificial Sequence
  Synthetic oligonucleotide
cuucuuaaugauugaacaaaauaccaa

SEQ ID NO: 1953 - RNA, 27 nt, Artificial Sequence
  Synthetic oligonucleotide
uucuuaaugauugaacaaaauaccaag

SEQ ID NO: 1954 - RNA, 27 nt, Artificial Sequence
  Synthetic oligonucleotide
ucuuaaugauugaacaaaauaccaagu

SEQ ID NO: 1955 - RNA, 27 nt, Artificial Sequence
  Synthetic oligonucleotide
cuuaaugauugaacaaaauaccaaguc

SEQ ID NO: 1956 - RNA, 27 nt, Artificial Sequence
  Synthetic oligonucleotide
uuaaugauugaacaaaauaccaagucu

SEQ ID NO: 1957 - RNA, 27 nt, Artificial Sequence
  Synthetic oligonucleotide
uaaugauugaacaaaauaccaagucuc

SEQ ID NO: 1958 - RNA, 27 nt, Artificial Sequence
  Synthetic oligonucleotide
aaugauugaacaaaauaccaagucucc

SEQ ID NO: 1959 - RNA, 27 nt, Artificial Sequence
  Synthetic oligonucleotide
augauugaacaaaauaccaagucuccc

SEQ ID NO: 1960 - RNA, 27 nt, Artificial Sequence
  Synthetic oligonucleotide
ugauugaacaaaauaccaagucucccc

SEQ ID NO: 1961 - RNA, 27 nt, Artificial Sequence
  Synthetic oligonucleotide
gauugaacaaaauaccaagucuccccu

SEQ ID NO: 1962 - RNA, 27 nt, Artificial Sequence
  Synthetic oligonucleotide
auugaacaaaauaccaagucuccccuc

SEQ ID NO: 1963 - RNA, 27 nt, Artificial Sequence
  Synthetic oligonucleotide
uugaacaaaauaccaagucuccccucu

SEQ ID NO: 1964 - RNA, 27 nt, Artificial Sequence
  Synthetic oligonucleotide
ugaacaaaauaccaagucuccccucuu

SEQ ID NO: 1965 - RNA, 27 nt, Artificial Sequence
  Synthetic oligonucleotide
gaacaaaauaccaagucuccccucuuc

SEQ ID NO: 1966 - RNA, 27 nt, Artificial Sequence
  Synthetic oligonucleotide
aacaaaauaccaagucuccccucuuca

SEQ ID NO: 1967 - RNA, 27 nt, Artificial Sequence
  Synthetic oligonucleotide
acaaaauaccaagucuccccucuucau

SEQ ID NO: 1968 - RNA, 27 nt, Artificial Sequence
  Synthetic oligonucleotide
caaaauaccaagucuccccucuucaug

SEQ ID NO: 1969 - RNA, 19 nt, Artificial Sequence
  Synthetic oligonucleotide
gcguuuaggcauguuuaac

SEQ ID NO: 1970 - RNA, 19 nt, Artificial Sequence
  Synthetic oligonucleotide
cguuuaggcauguuuaaca

SEQ ID NO: 1971 - RNA, 19 nt, Artificial Sequence
  Synthetic oligonucleotide
ggccauguuuuuagaggcc

SEQ ID NO: 1972 - RNA, 19 nt, Artificial Sequence
  Synthetic oligonucleotide
acccuuugucuucuuaaug

SEQ ID NO: 1973 - RNA, 19 nt, Artificial Sequence
  Synthetic oligonucleotide
cccuuugucuucuuaauga

SEQ ID NO: 1974 - RNA, 19 nt, Artificial Sequence
  Synthetic oligonucleotide
ccuuugucuucuuaaugau

SEQ ID NO: 1975 - RNA, 19 nt, Artificial Sequence
  Synthetic oligonucleotide
cuuugucuucuuaaugauu

SEQ ID NO: 1976 - RNA, 19 nt, Artificial Sequence
  Synthetic oligonucleotide
uuugucuucuuaaugauug

SEQ ID NO: 1977 - RNA, 19 nt, Artificial Sequence
  Synthetic oligonucleotide
uugucuucuuaaugauuga

SEQ ID NO: 1978 - RNA, 19 nt, Artificial Sequence
  Synthetic oligonucleotide
ugucuucuuaaugauugaa

SEQ ID NO: 1979 - RNA, 19 nt, Artificial Sequence
  Synthetic oligonucleotide
gucuucuuaaugauugaac

SEQ ID NO: 1980 - RNA, 19 nt, Artificial Sequence
  Synthetic oligonucleotide
ucuucuuaaugauugaaca

SEQ ID NO: 1981 - RNA, 19 nt, Artificial Sequence
  Synthetic oligonucleotide
cuucuuaaugauugaacaa

SEQ ID NO: 1982 - RNA, 19 nt, Artificial Sequence
  Synthetic oligonucleotide
uucuuaaugauugaacaaa

SEQ ID NO: 1983 - RNA, 19 nt, Artificial Sequence
  Synthetic oligonucleotide
ucuuaaugauugaacaaaa

SEQ ID NO: 1984 - RNA, 19 nt, Artificial Sequence
  Synthetic oligonucleotide
cuuaaugauugaacaaaau

SEQ ID NO: 1985 - RNA, 19 nt, Artificial Sequence
  Synthetic oligonucleotide
uuaaugauugaacaaaaua

SEQ ID NO: 1986 - RNA, 19 nt, Artificial Sequence
  Synthetic oligonucleotide
uaaugauugaacaaaauac

SEQ ID NO: 1987 - RNA, 19 nt, Artificial Sequence
  Synthetic oligonucleotide
aaugauugaacaaaauacc

SEQ ID NO: 1988 - RNA, 19 nt, Artificial Sequence
  Synthetic oligonucleotide
augauugaacaaaauacca

SEQ ID NO: 1989 - RNA, 19 nt, Artificial Sequence
  Synthetic oligonucleotide
ugauugaacaaaauaccaa

SEQ ID NO: 1990 - RNA, 19 nt, Artificial Sequence
  Synthetic oligonucleotide
gauugaacaaaauaccaag

SEQ ID NO: 1991 - RNA, 19 nt, Artificial Sequence
  Synthetic oligonucleotide
auugaacaaaauaccaagu

SEQ ID NO: 1992 - RNA, 19 nt, Artificial Sequence
  Synthetic oligonucleotide
uugaacaaaauaccaaguc

SEQ ID NO: 1993 - RNA, 19 nt, Artificial Sequence
  Synthetic oligonucleotide
ugaacaaaauaccaagucu

SEQ ID NO: 1994 - RNA, 19 nt, Artificial Sequence
  Synthetic oligonucleotide
gaacaaaauaccaagucuc

SEQ ID NO: 1995 - RNA, 19 nt, Artificial Sequence
  Synthetic oligonucleotide
aacaaaauaccaagucucc

SEQ ID NO: 1996 - RNA, 19 nt, Artificial Sequence
  Synthetic oligonucleotide
acaaaauaccaagucuccc

SEQ ID NO: 1997 - RNA, 19 nt, Artificial Sequence
  Synthetic oligonucleotide
caaaauaccaagucucccc

SEQ ID NO: 1998 - RNA, 19 nt, Artificial Sequence
  Synthetic oligonucleotide
aaaauaccaagucuccccu

SEQ ID NO: 1999 - RNA, 19 nt, Artificial Sequence
  Synthetic oligonucleotide
aaauaccaagucuccccuc

SEQ ID NO: 2000 - RNA, 19 nt, Artificial Sequence
  Synthetic oligonucleotide
agcguuuaggcauguuuaa

SEQ ID NO: 2001 - RNA, 19 nt, Artificial Sequence
  Synthetic oligonucleotide
gcguuuaggcauguuuaac

SEQ ID NO: 2002 - RNA, 19 nt, Artificial Sequence
  Synthetic oligonucleotide
gggccauguuuuuagaggc

SEQ ID NO: 2003 - RNA, 19 nt, Artificial Sequence
  Synthetic oligonucleotide
aacccuuugucuucuuaau

SEQ ID NO: 2004 - RNA, 19 nt, Artificial Sequence
  Synthetic oligonucleotide
acccuuugucuucuuaaug

SEQ ID NO: 2005 - RNA, 19 nt, Artificial Sequence
  Synthetic oligonucleotide
cccuuugucuucuuaauga

SEQ ID NO: 2006 - RNA, 19 nt, Artificial Sequence
  Synthetic oligonucleotide
ccuuugucuucuuaaugau

SEQ ID NO: 2007 - RNA, 19 nt, Artificial Sequence
  Synthetic oligonucleotide
cuuugucuucuuaaugauu

SEQ ID NO: 2008 - RNA, 19 nt, Artificial Sequence
  Synthetic oligonucleotide
uuugucuucuuaaugauug

SEQ ID NO: 2009 - RNA, 19 nt, Artificial Sequence
  Synthetic oligonucleotide
uugucuucuuaaugauuga

SEQ ID NO: 2010 - RNA, 19 nt, Artificial Sequence
  Synthetic oligonucleotide
ugucuucuuaaugauugaa

SEQ ID NO: 2011 - RNA, 19 nt, Artificial Sequence
  Synthetic oligonucleotide
gucuucuuaaugauugaac

SEQ ID NO: 2012 - RNA, 19 nt, Artificial Sequence
  Synthetic oligonucleotide
ucuucuuaaugauugaaca

SEQ ID NO: 2013 - RNA, 19 nt, Artificial Sequence
  Synthetic oligonucleotide
cuucuuaaugauugaacaa

SEQ ID NO: 2014 - RNA, 19 nt, Artificial Sequence
  Synthetic oligonucleotide
uucuuaaugauugaacaaa

SEQ ID NO: 2015 - RNA, 19 nt, Artificial Sequence
  Synthetic oligonucleotide
ucuuaaugauugaacaaaa

SEQ ID NO: 2016 - RNA, 19 nt, Artificial Sequence
  Synthetic oligonucleotide
cuuaaugauugaacaaaau

SEQ ID NO: 2017 - RNA, 19 nt, Artificial Sequence
  Synthetic oligonucleotide
uuaaugauugaacaaaaua

SEQ ID NO: 2018 - RNA, 19 nt, Artificial Sequence
  Synthetic oligonucleotide
uaaugauugaacaaaauac

SEQ ID NO: 2019 - RNA, 19 nt, Artificial Sequence
  Synthetic oligonucleotide
aaugauugaacaaaauacc

SEQ ID NO: 2020 - RNA, 19 nt, Artificial Sequence
  Synthetic oligonucleotide
augauugaacaaaauacca

SEQ ID NO: 2021 - RNA, 19 nt, Artificial Sequence
  Synthetic oligonucleotide
ugauugaacaaaauaccaa

SEQ ID NO: 2022 - RNA, 19 nt, Artificial Sequence
  Synthetic oligonucleotide
gauugaacaaaauaccaag

SEQ ID NO: 2023 - RNA, 19 nt, Artificial Sequence
  Synthetic oligonucleotide
auugaacaaaauaccaagu

SEQ ID NO: 2024 - RNA, 19 nt, Artificial Sequence
  Synthetic oligonucleotide
uugaacaaaauaccaaguc

SEQ ID NO: 2025 - RNA, 19 nt, Artificial Sequence
  Synthetic oligonucleotide
ugaacaaaauaccaagucu

SEQ ID NO: 2026 - RNA, 19 nt, Artificial Sequence
  Synthetic oligonucleotide
gaacaaaauaccaagucuc

SEQ ID NO: 2027 - RNA, 19 nt, Artificial Sequence
  Synthetic oligonucleotide
aacaaaauaccaagucucc

SEQ ID NO: 2028 - RNA, 19 nt, Artificial Sequence
  Synthetic oligonucleotide
acaaaauaccaagucuccc

SEQ ID NO: 2029 - RNA, 19 nt, Artificial Sequence
  Synthetic oligonucleotide
caaaauaccaagucucccc

SEQ ID NO: 2030 - RNA, 19 nt, Artificial Sequence
  Synthetic oligonucleotide
aaaauaccaagucuccccu

SEQ ID NO: 2031 - RNA, 19 nt, Artificial Sequence
  Synthetic oligonucleotide
aagcguuuaggcauguuua

SEQ ID NO: 2032 - RNA, 19 nt, Artificial Sequence
  Synthetic oligonucleotide
agcguuuaggcauguuuaa

SEQ ID NO: 2033 - RNA, 19 nt, Artificial Sequence
  Synthetic oligonucleotide
ggggccauguuuuuagagg

SEQ ID NO: 2034 - RNA, 19 nt, Artificial Sequence
  Synthetic oligonucleotide
aaacccuuugucuucuuaa

SEQ ID NO: 2035 - RNA, 19 nt, Artificial Sequence
  Synthetic oligonucleotide
aacccuuugucuucuuaau

SEQ ID NO: 2036 - RNA, 19 nt, Artificial Sequence
  Synthetic oligonucleotide
acccuuugucuucuuaaug

SEQ ID NO: 2037 - RNA, 19 nt, Artificial Sequence
  Synthetic oligonucleotide
cccuuugucuucuuaauga

SEQ ID NO: 2038 - RNA, 19 nt, Artificial Sequence
  Synthetic oligonucleotide
ccuuugucuucuuaaugau

SEQ ID NO: 2039 - RNA, 19 nt, Artificial Sequence
  Synthetic oligonucleotide
cuuugucuucuuaaugauu

SEQ ID NO: 2040 - RNA, 19 nt, Artificial Sequence
  Synthetic oligonucleotide
uuugucuucuuaaugauug

SEQ ID NO: 2041 - RNA, 19 nt, Artificial Sequence
  Synthetic oligonucleotide
uugucuucuuaaugauuga

SEQ ID NO: 2042 - RNA, 19 nt, Artificial Sequence
  Synthetic oligonucleotide
ugucuucuuaaugauugaa

SEQ ID NO: 2043 - RNA, 19 nt, Artificial Sequence
  Synthetic oligonucleotide
gucuucuuaaugauugaac

SEQ ID NO: 2044 - RNA, 19 nt, Artificial Sequence
  Synthetic oligonucleotide
ucuucuuaaugauugaaca

SEQ ID NO: 2045 - RNA, 19 nt, Artificial Sequence
  Synthetic oligonucleotide
cuucuuaaugauugaacaa

SEQ ID NO: 2046 - RNA, 19 nt, Artificial Sequence
  Synthetic oligonucleotide
uucuuaaugauugaacaaa

SEQ ID NO: 2047 - RNA, 19 nt, Artificial Sequence
  Synthetic oligonucleotide
ucuuaaugauugaacaaaa

SEQ ID NO: 2048 - RNA, 19 nt, Artificial Sequence
  Synthetic oligonucleotide
cuuaaugauugaacaaaau

SEQ ID NO: 2049 - RNA, 19 nt, Artificial Sequence
  Synthetic oligonucleotide
uuaaugauugaacaaaaua

SEQ ID NO: 2050 - RNA, 19 nt, Artificial Sequence
  Synthetic oligonucleotide
uaaugauugaacaaaauac

SEQ ID NO: 2051 - RNA, 19 nt, Artificial Sequence
  Synthetic oligonucleotide
aaugauugaacaaaauacc

SEQ ID NO: 2052 - RNA, 19 nt, Artificial Sequence
  Synthetic oligonucleotide
augauugaacaaaauacca

SEQ ID NO: 2053 - RNA, 19 nt, Artificial Sequence
  Synthetic oligonucleotide
ugauugaacaaaauaccaa

SEQ ID NO: 2054 - RNA, 19 nt, Artificial Sequence
  Synthetic oligonucleotide
gauugaacaaaauaccaag

SEQ ID NO: 2055 - RNA, 19 nt, Artificial Sequence
  Synthetic oligonucleotide
auugaacaaaauaccaagu

SEQ ID NO: 2056 - RNA, 19 nt, Artificial Sequence
  Synthetic oligonucleotide
uugaacaaaauaccaaguc

SEQ ID NO: 2057 - RNA, 19 nt, Artificial Sequence
  Synthetic oligonucleotide
ugaacaaaauaccaagucu

SEQ ID NO: 2058 - RNA, 19 nt, Artificial Sequence
  Synthetic oligonucleotide
gaacaaaauaccaagucuc

SEQ ID NO: 2059 - RNA, 19 nt, Artificial Sequence
  Synthetic oligonucleotide
aacaaaauaccaagucucc

SEQ ID NO: 2060 - RNA, 19 nt, Artificial Sequence
  Synthetic oligonucleotide
acaaaauaccaagucuccc

SEQ ID NO: 2061 - RNA, 19 nt, Artificial Sequence
  Synthetic oligonucleotide
caaaauaccaagucucccc

SEQ ID NO: 2062 - DNA, 25 bp, Artificial Sequence
  Synthetic oligonucleotide
ccagggagaugcugcccagaagaca

SEQ ID NO: 2063 - DNA, 25 bp, Artificial Sequence
  Synthetic oligonucleotide
cagggagaugcugcccagaagacag

SEQ ID NO: 2064 - DNA, 25 bp, Artificial Sequence
  Synthetic oligonucleotide
agggagaugcugcccagaagacaga

SEQ ID NO: 2065 - DNA, 25 bp, Artificial Sequence
  Synthetic oligonucleotide
gggagaugcugcccagaagacagat

SEQ ID NO: 2066 - DNA, 25 bp, Artificial Sequence
  Synthetic oligonucleotide
ggagaugcugcccagaagacagata

SEQ ID NO: 2067 - DNA, 25 bp, Artificial Sequence
  Synthetic oligonucleotide
gagaugcugcccagaagacagauac

SEQ ID NO: 2068 - DNA, 25 bp, Artificial Sequence
  Synthetic oligonucleotide
gauacaucccaccaugaucaggatc

SEQ ID NO: 2069 - DNA, 25 bp, Artificial Sequence
  Synthetic oligonucleotide
auacaucccaccaugaucaggauca

SEQ ID NO: 2070 - DNA, 25 bp, Artificial Sequence
  Synthetic oligonucleotide
uacaucccaccaugaucaggaucac

SEQ ID NO: 2071 - DNA, 25 bp, Artificial Sequence
  Synthetic oligonucleotide
acaucccaccaugaucaggaucacc

SEQ ID NO: 2072 - DNA, 25 bp, Artificial Sequence
  Synthetic oligonucleotide
accaguccaacagcaccaauauctt

SEQ ID NO: 2073 - DNA, 25 bp, Artificial Sequence
  Synthetic oligonucleotide
ccaguccaacagcaccaauaucutc

SEQ ID NO: 2074 - DNA, 25 bp, Artificial Sequence
  Synthetic oligonucleotide
caguccaacagcaccaauaucuuct

SEQ ID NO: 2075 - DNA, 25 bp, Artificial Sequence
  Synthetic oligonucleotide
aguccaacagcaccaauaucuuctt

SEQ ID NO: 2076 - DNA, 25 bp, Artificial Sequence
  Synthetic oligonucleotide
guccaacagcaccaauaucuucutc

SEQ ID NO: 2077 - DNA, 25 bp, Artificial Sequence
  Synthetic oligonucleotide
uccaacagcaccaauaucuucuuct

SEQ ID NO: 2078 - DNA, 25 bp, Artificial Sequence
  Synthetic oligonucleotide
ccaacagcaccaauaucuucuuctc

SEQ ID NO: 2079 - DNA, 25 bp, Artificial Sequence
  Synthetic oligonucleotide
caacagcaccaauaucuucuucucc

SEQ ID NO: 2080 - DNA, 25 bp, Artificial Sequence
  Synthetic oligonucleotide
aacagcaccaauaucuucuucuccc

SEQ ID NO: 2081 - DNA, 25 bp, Artificial Sequence
  Synthetic oligonucleotide
acagcaccaauaucuucuucucccc

SEQ ID NO: 2082 - DNA, 25 bp, Artificial Sequence
  Synthetic oligonucleotide
cagcaccaauaucuucuucucccca

SEQ ID NO: 2083 - DNA, 25 bp, Artificial Sequence
  Synthetic oligonucleotide
agcaccaauaucuucuucuccccag

SEQ ID NO: 2084 - DNA, 25 bp, Artificial Sequence
  Synthetic oligonucleotide
gcaccaauaucuucuucuccccagt

SEQ ID NO: 2085 - DNA, 25 bp, Artificial Sequence
  Synthetic oligonucleotide
caccaauaucuucuucuccccagtg

SEQ ID NO: 2086 - DNA, 25 bp, Artificial Sequence
  Synthetic oligonucleotide
accaauaucuucuucuccccaguga

SEQ ID NO: 2087 - DNA, 25 bp, Artificial Sequence
  Synthetic oligonucleotide
cccagugagcaucgcuacagccutt

SEQ ID NO: 2088 - DNA, 25 bp, Artificial Sequence
  Synthetic oligonucleotide
ccagugagcaucgcuacagccuutg

SEQ ID NO: 2089 - DNA, 25 bp, Artificial Sequence
  Synthetic oligonucleotide
cagugagcaucgcuacagccuuugc

SEQ ID NO: 2090 - DNA, 25 bp, Artificial Sequence
  Synthetic oligonucleotide
agugagcaucgcuacagccuuugca

SEQ ID NO: 2091 - DNA, 25 bp, Artificial Sequence
  Synthetic oligonucleotide
gugagcaucgcuacagccuuugcaa

SEQ ID NO: 2092 - DNA, 25 bp, Artificial Sequence
  Synthetic oligonucleotide
ugagcaucgcuacagccuuugcaat

SEQ ID NO: 2093 - DNA, 25 bp, Artificial Sequence
  Synthetic oligonucleotide
gagcaucgcuacagccuuugcaatg

SEQ ID NO: 2094 - DNA, 25 bp, Artificial Sequence
  Synthetic oligonucleotide
agcaucgcuacagccuuugcaaugc

SEQ ID NO: 2095 - DNA, 25 bp, Artificial Sequence
  Synthetic oligonucleotide
gcaucgcuacagccuuugcaaugct

SEQ ID NO: 2096 - DNA, 25 bp, Artificial Sequence
  Synthetic oligonucleotide
caucgcuacagccuuugcaaugctc

SEQ ID NO: 2097 - DNA, 25 bp, Artificial Sequence
  Synthetic oligonucleotide
aucgcuacagccuuugcaaugcuct

SEQ ID NO: 2098 - DNA, 25 bp, Artificial Sequence
  Synthetic oligonucleotide
ucgcuacagccuuugcaaugcuctc

SEQ ID NO: 2099 - DNA, 25 bp, Artificial Sequence
  Synthetic oligonucleotide
cgcuacagccuuugcaaugcucucc

SEQ ID NO: 2100 - DNA, 25 bp, Artificial Sequence
  Synthetic oligonucleotide
gcuacagccuuugcaaugcucuccc

SEQ ID NO: 2101 - DNA, 25 bp, Artificial Sequence
  Synthetic oligonucleotide
cuacagccuuugcaaugcucuccct

SEQ ID NO: 2102 - DNA, 25 bp, Artificial Sequence
  Synthetic oligonucleotide
uacagccuuugcaaugcucuccctg

SEQ ID NO: 2103 - DNA, 25 bp, Artificial Sequence
  Synthetic oligonucleotide
ccuggggaccaaggcugacacucac

SEQ ID NO: 2104 - DNA, 25 bp, Artificial Sequence
  Synthetic oligonucleotide
gggaccaaggcugacacucacgatg

SEQ ID NO: 2105 - DNA, 25 bp, Artificial Sequence
  Synthetic oligonucleotide
ggaccaaggcugacacucacgauga

SEQ ID NO: 2106 - DNA, 25 bp, Artificial Sequence
  Synthetic oligonucleotide
gaccaaggcugacacucacgaugaa

SEQ ID NO: 2107 - DNA, 25 bp, Artificial Sequence
  Synthetic oligonucleotide
ugaaauccuggagggccugaauutc

SEQ ID NO: 2108 - DNA, 25 bp, Artificial Sequence
  Synthetic oligonucleotide
gaaauccuggagggccugaauuuca

SEQ ID NO: 2109 - DNA, 25 bp, Artificial Sequence
  Synthetic oligonucleotide
uccaugaaggcuuccaggaacucct

SEQ ID NO: 2110 - DNA, 25 bp, Artificial Sequence
  Synthetic oligonucleotide
ccaugaaggcuuccaggaacucctc

SEQ ID NO: 2111 - DNA, 25 bp, Artificial Sequence
  Synthetic oligonucleotide
ggacaccgaagaggccaagaaacag

SEQ ID NO: 2112 - DNA, 25 bp, Artificial Sequence
  Synthetic oligonucleotide
gacaccgaagaggccaagaaacaga

SEQ ID NO: 2113 - DNA, 25 bp, Artificial Sequence
  Synthetic oligonucleotide
acaccgaagaggccaagaaacagat

SEQ ID NO: 2114 - DNA, 25 bp, Artificial Sequence
  Synthetic oligonucleotide
caccgaagaggccaagaaacagatc

SEQ ID NO: 2115 - DNA, 25 bp, Artificial Sequence
  Synthetic oligonucleotide
accgaagaggccaagaaacagauca

SEQ ID NO: 2116 - DNA, 25 bp, Artificial Sequence
  Synthetic oligonucleotide
ccgaagaggccaagaaacagaucaa

SEQ ID NO: 2117 - DNA, 25 bp, Artificial Sequence
  Synthetic oligonucleotide
cgaagaggccaagaaacagaucaac

SEQ ID NO: 2118 - DNA, 25 bp, Artificial Sequence
  Synthetic oligonucleotide
gaagaggccaagaaacagaucaacg

SEQ ID NO: 2119 - DNA, 25 bp, Artificial Sequence
  Synthetic oligonucleotide
aagaggccaagaaacagaucaacga

SEQ ID NO: 2120 - DNA, 25 bp, Artificial Sequence
  Synthetic oligonucleotide
agaggccaagaaacagaucaacgat

SEQ ID NO: 2121 - DNA, 25 bp, Artificial Sequence
  Synthetic oligonucleotide
gaggccaagaaacagaucaacgatt

SEQ ID NO: 2122 - DNA, 25 bp, Artificial Sequence
  Synthetic oligonucleotide
aggccaagaaacagaucaacgauta

SEQ ID NO: 2123 - DNA, 25 bp, Artificial Sequence
  Synthetic oligonucleotide
ggccaagaaacagaucaacgauuac

SEQ ID NO: 2124 - DNA, 25 bp, Artificial Sequence
  Synthetic oligonucleotide
uuuugcucuggugaauuacaucutc

SEQ ID NO: 2125 - DNA, 25 bp, Artificial Sequence
  Synthetic oligonucleotide
uuugcucuggugaauuacaucuuct

SEQ ID NO: 2126 - DNA, 25 bp, Artificial Sequence
  Synthetic oligonucleotide
uugcucuggugaauuacaucuuctt

SEQ ID NO: 2127 - DNA, 25 bp, Artificial Sequence
  Synthetic oligonucleotide
ugcucuggugaauuacaucuucutt

SEQ ID NO: 2128 - DNA, 25 bp, Artificial Sequence
  Synthetic oligonucleotide
gcucuggugaauuacaucuucuuta

SEQ ID NO: 2129 - DNA, 25 bp, Artificial Sequence
  Synthetic oligonucleotide
cucuggugaauuacaucuucuuuaa

SEQ ID NO: 2130 - DNA, 25 bp, Artificial Sequence
  Synthetic oligonucleotide
ucuggugaauuacaucuucuuuaaa

SEQ ID NO: 2131 - DNA, 25 bp, Artificial Sequence
  Synthetic oligonucleotide
cuggugaauuacaucuucuuuaaag

SEQ ID NO: 2132 - DNA, 25 bp, Artificial Sequence
  Synthetic oligonucleotide
uggugaauuacaucuucuuuaaagg

SEQ ID NO: 2133 - DNA, 25 bp, Artificial Sequence
  Synthetic oligonucleotide
ggugaauuacaucuucuuuaaaggc

SEQ ID NO: 2134 - DNA, 25 bp, Artificial Sequence
  Synthetic oligonucleotide
gugaauuacaucuucuuuaaaggca

SEQ ID NO: 2135 - DNA, 25 bp, Artificial Sequence
  Synthetic oligonucleotide
ugaauuacaucuucuuuaaaggcaa

SEQ ID NO: 2136 - DNA, 25 bp, Artificial Sequence
  Synthetic oligonucleotide
gaauuacaucuucuuuaaaggcaaa

SEQ ID NO: 2137 - DNA, 25 bp, Artificial Sequence
  Synthetic oligonucleotide
aauuacaucuucuuuaaaggcaaat

SEQ ID NO: 2138 - DNA, 25 bp, Artificial Sequence
  Synthetic oligonucleotide
auuacaucuucuuuaaaggcaaatg

SEQ ID NO: 2139 - DNA, 25 bp, Artificial Sequence
  Synthetic oligonucleotide
uuacaucuucuuuaaaggcaaaugg

SEQ ID NO: 2140 - DNA, 25 bp, Artificial Sequence
  Synthetic oligonucleotide
uacaucuucuuuaaaggcaaauggg

SEQ ID NO: 2141 - DNA, 25 bp, Artificial Sequence
  Synthetic oligonucleotide
acaucuucuuuaaaggcaaauggga

SEQ ID NO: 2142 - DNA, 25 bp, Artificial Sequence
  Synthetic oligonucleotide
caucuucuuuaaaggcaaaugggag

SEQ ID NO: 2143 - DNA, 25 bp, Artificial Sequence
  Synthetic oligonucleotide
uucuuuaaaggcaaaugggagagac

SEQ ID NO: 2144 - DNA, 25 bp, Artificial Sequence
  Synthetic oligonucleotide
cuuuaaaggcaaaugggagagaccc

SEQ ID NO: 2145 - DNA, 25 bp, Artificial Sequence
  Synthetic oligonucleotide
gcaaaugggagagacccuuugaagt

SEQ ID NO: 2146 - DNA, 25 bp, Artificial Sequence
  Synthetic oligonucleotide
caaaugggagagacccuuugaagtc

SEQ ID NO: 2147 - DNA, 25 bp, Artificial Sequence
  Synthetic oligonucleotide
aaaugggagagacccuuugaaguca

SEQ ID NO: 2148 - DNA, 25 bp, Artificial Sequence
  Synthetic oligonucleotide
aaugggagagacccuuugaagucaa

SEQ ID NO: 2149 - DNA, 25 bp, Artificial Sequence
  Synthetic oligonucleotide
uguccagcugggugcugcugaugaa

SEQ ID NO: 2150 - DNA, 25 bp, Artificial Sequence
  Synthetic oligonucleotide
guccagcugggugcugcugaugaaa

SEQ ID NO: 2151 - DNA, 25 bp, Artificial Sequence
  Synthetic oligonucleotide
uccagcugggugcugcugaugaaat

SEQ ID NO: 2152 - DNA, 25 bp, Artificial Sequence
  Synthetic oligonucleotide
ccagcugggugcugcugaugaaata

SEQ ID NO: 2153 - DNA, 25 bp, Artificial Sequence
  Synthetic oligonucleotide
cagcugggugcugcugaugaaauac

SEQ ID NO: 2154 - DNA, 25 bp, Artificial Sequence
  Synthetic oligonucleotide
agcugggugcugcugaugaaauacc

SEQ ID NO: 2155 - DNA, 25 bp, Artificial Sequence
  Synthetic oligonucleotide
gcugggugcugcugaugaaauacct

SEQ ID NO: 2156 - DNA, 25 bp, Artificial Sequence
  Synthetic oligonucleotide
cugggugcugcugaugaaauacctg

SEQ ID NO: 2157 - DNA, 25 bp, Artificial Sequence
  Synthetic oligonucleotide
ugggugcugcugaugaaauaccugg

SEQ ID NO: 2158 - DNA, 25 bp, Artificial Sequence
  Synthetic oligonucleotide
gggugcugcugaugaaauaccuggg

SEQ ID NO: 2159 - DNA, 25 bp, Artificial Sequence
  Synthetic oligonucleotide
gugcugcugaugaaauaccugggca

SEQ ID NO: 2160 - DNA, 25 bp, Artificial Sequence
  Synthetic oligonucleotide
ugcugcugaugaaauaccugggcaa

SEQ ID NO: 2161 - DNA, 25 bp, Artificial Sequence
  Synthetic oligonucleotide
gcugcugaugaaauaccugggcaat

SEQ ID NO: 2162 - DNA, 25 bp, Artificial Sequence
  Synthetic oligonucleotide
cugcugaugaaauaccugggcaatg

SEQ ID NO: 2163 - DNA, 25 bp, Artificial Sequence
  Synthetic oligonucleotide
ugcugaugaaauaccugggcaaugc

SEQ ID NO: 2164 - DNA, 25 bp, Artificial Sequence
  Synthetic oligonucleotide
gcugaugaaauaccugggcaaugcc

SEQ ID NO: 2165 - DNA, 25 bp, Artificial Sequence
  Synthetic oligonucleotide
cugaugaaauaccugggcaaugcca

SEQ ID NO: 2166 - DNA, 25 bp, Artificial Sequence
  Synthetic oligonucleotide
ugaugaaauaccugggcaaugccac

SEQ ID NO: 2167 - DNA, 25 bp, Artificial Sequence
  Synthetic oligonucleotide
gaugaaauaccugggcaaugccacc

SEQ ID NO: 2168 - DNA, 25 bp, Artificial Sequence
  Synthetic oligonucleotide
augaaauaccugggcaaugccaccg

SEQ ID NO: 2169 - DNA, 25 bp, Artificial Sequence
  Synthetic oligonucleotide
gaaauaccugggcaaugccaccgcc

SEQ ID NO: 2170 - DNA, 25 bp, Artificial Sequence
  Synthetic oligonucleotide
cagcaccuggaaaaugaacucaccc

SEQ ID NO: 2171 - DNA, 25 bp, Artificial Sequence
  Synthetic oligonucleotide
cuggaaaaugaacucacccacgata

SEQ ID NO: 2172 - DNA, 25 bp, Artificial Sequence
  Synthetic oligonucleotide
uggaaaaugaacucacccacgauat

SEQ ID NO: 2173 - DNA, 25 bp, Artificial Sequence
  Synthetic oligonucleotide
gauaucaucaccaaguuccuggaaa

SEQ ID NO: 2174 - DNA, 25 bp, Artificial Sequence
  Synthetic oligonucleotide
caaguuccuggaaaaugaagacaga

SEQ ID NO: 2175 - DNA, 25 bp, Artificial Sequence
  Synthetic oligonucleotide
ccauuacuggaaccuaugaucugaa

SEQ ID NO: 2176 - DNA, 25 bp, Artificial Sequence
  Synthetic oligonucleotide
cauuacuggaaccuaugaucugaag

SEQ ID NO: 2177 - DNA, 25 bp, Artificial Sequence
  Synthetic oligonucleotide
auuacuggaaccuaugaucugaaga

SEQ ID NO: 2178 - DNA, 25 bp, Artificial Sequence
  Synthetic oligonucleotide
uuacuggaaccuaugaucugaagag

SEQ ID NO: 2179 - DNA, 25 bp, Artificial Sequence
  Synthetic oligonucleotide
uacuggaaccuaugaucugaagagc

SEQ ID NO: 2180 - DNA, 25 bp, Artificial Sequence
  Synthetic oligonucleotide
acuggaaccuaugaucugaagagcg

SEQ ID NO: 2181 - DNA, 25 bp, Artificial Sequence
  Synthetic oligonucleotide
cuggaaccuaugaucugaagagcgt

SEQ ID NO: 2182 - DNA, 25 bp, Artificial Sequence
  Synthetic oligonucleotide
uggaaccuaugaucugaagagcgtc

SEQ ID NO: 2183 - DNA, 25 bp, Artificial Sequence
  Synthetic oligonucleotide
ggaaccuaugaucugaagagcgucc

SEQ ID NO: 2184 - DNA, 25 bp, Artificial Sequence
  Synthetic oligonucleotide
aucacuaaggucuucagcaaugggg

SEQ ID NO: 2185 - DNA, 25 bp, Artificial Sequence
  Synthetic oligonucleotide
ucacuaaggucuucagcaauggggc

SEQ ID NO: 2186 - DNA, 25 bp, Artificial Sequence
  Synthetic oligonucleotide
cacuaaggucuucagcaauggggct

SEQ ID NO: 2187 - DNA, 25 bp, Artificial Sequence
  Synthetic oligonucleotide
cuaaggucuucagcaauggggcuga

SEQ ID NO: 2188 - DNA, 25 bp, Artificial Sequence
  Synthetic oligonucleotide
uaaggucuucagcaauggggcugac

SEQ ID NO: 2189 - DNA, 25 bp, Artificial Sequence
  Synthetic oligonucleotide
ugaagcucuccaaggccgugcauaa

SEQ ID NO: 2190 - DNA, 25 bp, Artificial Sequence
  Synthetic oligonucleotide
gaagcucuccaaggccgugcauaag

SEQ ID NO: 2191 - DNA, 25 bp, Artificial Sequence
  Synthetic oligonucleotide
aagcucuccaaggccgugcauaagg

SEQ ID NO: 2192 - DNA, 25 bp, Artificial Sequence
  Synthetic oligonucleotide
ccgaggucaaguucaacaaaccctt

SEQ ID NO: 2193 - DNA, 25 bp, Artificial Sequence
  Synthetic oligonucleotide
cgaggucaaguucaacaaacccutt

SEQ ID NO: 2194 - DNA, 25 bp, Artificial Sequence
  Synthetic oligonucleotide
gaggucaaguucaacaaacccuutg

SEQ ID NO: 2195 - DNA, 25 bp, Artificial Sequence
  Synthetic oligonucleotide
aggucaaguucaacaaacccuuugt

SEQ ID NO: 2196 - DNA, 25 bp, Artificial Sequence
  Synthetic oligonucleotide
ggucaaguucaacaaacccuuugtc

SEQ ID NO: 2197 - DNA, 25 bp, Artificial Sequence
  Synthetic oligonucleotide
gucaaguucaacaaacccuuuguct

SEQ ID NO: 2198 - DNA, 25 bp, Artificial Sequence
  Synthetic oligonucleotide
ucaaguucaacaaacccuuuguctt

SEQ ID NO: 2199 - DNA, 25 bp, Artificial Sequence
  Synthetic oligonucleotide
caaguucaacaaacccuuugucutc

SEQ ID NO: 2200 - DNA, 25 bp, Artificial Sequence
  Synthetic oligonucleotide
aaguucaacaaacccuuugucuuct

SEQ ID NO: 2201 - DNA, 25 bp, Artificial Sequence
  Synthetic oligonucleotide
aguucaacaaacccuuugucuuctt

SEQ ID NO: 2202 - RNA, 27 nt, Artificial Sequence
  Synthetic oligonucleotide
ugucuucugggcagcaucucccugggg

SEQ ID NO: 2203 - RNA, 27 nt, Artificial Sequence
  Synthetic oligonucleotide
cugucuucugggcagcaucucccuggg

SEQ ID NO: 2204 - RNA, 27 nt, Artificial Sequence
  Synthetic oligonucleotide
ucugucuucugggcagcaucucccugg

SEQ ID NO: 2205 - RNA, 27 nt, Artificial Sequence
  Synthetic oligonucleotide
aucugucuucugggcagcaucucccug

SEQ ID NO: 2206 - RNA, 27 nt, Artificial Sequence
  Synthetic oligonucleotide
uaucugucuucugggcagcaucucccu

SEQ ID NO: 2207 - RNA, 27 nt, Artificial Sequence
  Synthetic oligonucleotide
guaucugucuucugggcagcaucuccc

SEQ ID NO: 2208 - RNA, 27 nt, Artificial Sequence
  Synthetic oligonucleotide
gauccugaucauggugggauguaucug

SEQ ID NO: 2209 - RNA, 27 nt, Artificial Sequence
  Synthetic oligonucleotide
ugauccugaucauggugggauguaucu

SEQ ID NO: 2210 - RNA, 27 nt, Artificial Sequence
  Synthetic oligonucleotide
gugauccugaucauggugggauguauc

SEQ ID NO: 2211 - RNA, 27 nt, Artificial Sequence
  Synthetic oligonucleotide
ggugauccugaucauggugggauguau

SEQ ID NO: 2212 - RNA, 27 nt, Artificial Sequence
  Synthetic oligonucleotide
aagauauuggugcuguuggacuggugu

SEQ ID NO: 2213 - RNA, 27 nt, Artificial Sequence
  Synthetic oligonucleotide
gaagauauuggugcuguuggacuggug

SEQ ID NO: 2214 - RNA, 27 nt, Artificial Sequence
  Synthetic oligonucleotide
agaagauauuggugcuguuggacuggu

SEQ ID NO: 2215 - RNA, 27 nt, Artificial Sequence
  Synthetic oligonucleotide
aagaagauauuggugcuguuggacugg

SEQ ID NO: 2216 - RNA, 27 nt, Artificial Sequence
  Synthetic oligonucleotide
gaagaagauauuggugcuguuggacug

SEQ ID NO: 2217 - RNA, 27 nt, Artificial Sequence
  Synthetic oligonucleotide
agaagaagauauuggugcuguuggacu

SEQ ID NO: 2218 - RNA, 27 nt, Artificial Sequence
  Synthetic oligonucleotide
gagaagaagauauuggugcuguuggac

SEQ ID NO: 2219 - RNA, 27 nt, Artificial Sequence
  Synthetic oligonucleotide
ggagaagaagauauuggugcuguugga

SEQ ID NO: 2220 - RNA, 27 nt, Artificial Sequence
  Synthetic oligonucleotide
gggagaagaagauauuggugcuguugg

SEQ ID NO: 2221 - RNA, 27 nt, Artificial Sequence
  Synthetic oligonucleotide
ggggagaagaagauauuggugcuguug

SEQ ID NO: 2222 - RNA, 27 nt, Artificial Sequence
  Synthetic oligonucleotide
uggggagaagaagauauuggugcuguu

SEQ ID NO: 2223 - RNA, 27 nt, Artificial Sequence
  Synthetic oligonucleotide
cuggggagaagaagauauuggugcugu

SEQ ID NO: 2224 - RNA, 27 nt, Artificial Sequence
  Synthetic oligonucleotide
acuggggagaagaagauauuggugcug

SEQ ID NO: 2225 - RNA, 27 nt, Artificial Sequence
  Synthetic oligonucleotide
cacuggggagaagaagauauuggugcu

SEQ ID NO: 2226 - RNA, 27 nt, Artificial Sequence
  Synthetic oligonucleotide
ucacuggggagaagaagauauuggugc

SEQ ID NO: 2227 - RNA, 27 nt, Artificial Sequence
  Synthetic oligonucleotide
aaaggcuguagcgaugcucacugggga

SEQ ID NO: 2228 - RNA, 27 nt, Artificial Sequence
  Synthetic oligonucleotide
caaaggcuguagcgaugcucacugggg

SEQ ID NO: 2229 - RNA, 27 nt, Artificial Sequence
  Synthetic oligonucleotide
gcaaaggcuguagcgaugcucacuggg

SEQ ID NO: 2230 - RNA, 27 nt, Artificial Sequence
  Synthetic oligonucleotide
ugcaaaggcuguagcgaugcucacugg

SEQ ID NO: 2231 - RNA, 27 nt, Artificial Sequence
  Synthetic oligonucleotide
uugcaaaggcuguagcgaugcucacug

SEQ ID NO: 2232 - RNA, 27 nt, Artificial Sequence
  Synthetic oligonucleotide
auugcaaaggcuguagcgaugcucacu

SEQ ID NO: 2233 - RNA, 27 nt, Artificial Sequence
  Synthetic oligonucleotide
cauugcaaaggcuguagcgaugcucac

SEQ ID NO: 2234 - RNA, 27 nt, Artificial Sequence
  Synthetic oligonucleotide
gcauugcaaaggcuguagcgaugcuca

SEQ ID NO: 2235 - RNA, 27 nt, Artificial Sequence
  Synthetic oligonucleotide
agcauugcaaaggcuguagcgaugcuc

SEQ ID NO: 2236 - RNA, 27 nt, Artificial Sequence
  Synthetic oligonucleotide
gagcauugcaaaggcuguagcgaugcu

SEQ ID NO: 2237 - RNA, 27 nt, Artificial Sequence
  Synthetic oligonucleotide
agagcauugcaaaggcuguagcgaugc

SEQ ID NO: 2238 - RNA, 27 nt, Artificial Sequence
  Synthetic oligonucleotide
gagagcauugcaaaggcuguagcgaug

SEQ ID NO: 2239 - RNA, 27 nt, Artificial Sequence
  Synthetic oligonucleotide
ggagagcauugcaaaggcuguagcgau

SEQ ID NO: 2240 - RNA, 27 nt, Artificial Sequence
  Synthetic oligonucleotide
gggagagcauugcaaaggcuguagcga

SEQ ID NO: 2241 - RNA, 27 nt, Artificial Sequence
  Synthetic oligonucleotide
agggagagcauugcaaaggcuguagcg

SEQ ID NO: 2242 - RNA, 27 nt, Artificial Sequence
  Synthetic oligonucleotide
cagggagagcauugcaaaggcuguagc

SEQ ID NO: 2243 - RNA, 27 nt, Artificial Sequence
  Synthetic oligonucleotide
gugagugucagccuugguccccaggga

SEQ ID NO: 2244 - RNA, 27 nt, Artificial Sequence
  Synthetic oligonucleotide
caucgugagugucagccuuggucccca

SEQ ID NO: 2245 - RNA, 27 nt, Artificial Sequence
  Synthetic oligonucleotide
ucaucgugagugucagccuuggucccc

SEQ ID NO: 2246 - RNA, 27 nt, Artificial Sequence
  Synthetic oligonucleotide
uucaucgugagugucagccuugguccc

SEQ ID NO: 2247 - RNA, 27 nt, Artificial Sequence
  Synthetic oligonucleotide
gaaauucaggcccuccaggauuucauc

SEQ ID NO: 2248 - RNA, 27 nt, Artificial Sequence
  Synthetic oligonucleotide
ugaaauucaggcccuccaggauuucau

SEQ ID NO: 2249 - RNA, 27 nt, Artificial Sequence
  Synthetic oligonucleotide
aggaguuccuggaagccuucauggauc

SEQ ID NO: 2250 - RNA, 27 nt, Artificial Sequence
  Synthetic oligonucleotide
gaggaguuccuggaagccuucauggau

SEQ ID NO: 2251 - RNA, 27 nt, Artificial Sequence
  Synthetic oligonucleotide
cuguuucuuggccucuucggugucccc

SEQ ID NO: 2252 - RNA, 27 nt, Artificial Sequence
  Synthetic oligonucleotide
ucuguuucuuggccucuucgguguccc

SEQ ID NO: 2253 - RNA, 27 nt, Artificial Sequence
  Synthetic oligonucleotide
aucuguuucuuggccucuucggugucc

SEQ ID NO: 2254 - RNA, 27 nt, Artificial Sequence
  Synthetic oligonucleotide
gaucuguuucuuggccucuucgguguc

SEQ ID NO: 2255 - RNA, 27 nt, Artificial Sequence
  Synthetic oligonucleotide
ugaucuguuucuuggccucuucggugu

SEQ ID NO: 2256 - RNA, 27 nt, Artificial Sequence
  Synthetic oligonucleotide
uugaucuguuucuuggccucuucggug

SEQ ID NO: 2257 - RNA, 27 nt, Artificial Sequence
  Synthetic oligonucleotide
guugaucuguuucuuggccucuucggu

SEQ ID NO: 2258 - RNA, 27 nt, Artificial Sequence
  Synthetic oligonucleotide
cguugaucuguuucuuggccucuucgg

SEQ ID NO: 2259 - RNA, 27 nt, Artificial Sequence
  Synthetic oligonucleotide
ucguugaucuguuucuuggccucuucg

SEQ ID NO: 2260 - RNA, 27 nt, Artificial Sequence
  Synthetic oligonucleotide
aucguugaucuguuucuuggccucuuc

SEQ ID NO: 2261 - RNA, 27 nt, Artificial Sequence
  Synthetic oligonucleotide
aaucguugaucuguuucuuggccucuu

SEQ ID NO: 2262 - RNA, 27 nt, Artificial Sequence
  Synthetic oligonucleotide
uaaucguugaucuguuucuuggccucu

SEQ ID NO: 2263 - RNA, 27 nt, Artificial Sequence
  Synthetic oligonucleotide
guaaucguugaucuguuucuuggccuc

SEQ ID NO: 2264 - RNA, 27 nt, Artificial Sequence
  Synthetic oligonucleotide
gaagauguaauucaccagagcaaaaac

SEQ ID NO: 2265 - RNA, 27 nt, Artificial Sequence
  Synthetic oligonucleotide
agaagauguaauucaccagagcaaaaa

SEQ ID NO: 2266 - RNA, 27 nt, Artificial Sequence
  Synthetic oligonucleotide
aagaagauguaauucaccagagcaaaa

SEQ ID NO: 2267 - RNA, 27 nt, Artificial Sequence
  Synthetic oligonucleotide
aaagaagauguaauucaccagagcaaa

SEQ ID NO: 2268 - RNA, 27 nt, Artificial Sequence
  Synthetic oligonucleotide
uaaagaagauguaauucaccagagcaa

SEQ ID NO: 2269 - RNA, 27 nt, Artificial Sequence
  Synthetic oligonucleotide
uuaaagaagauguaauucaccagagca

SEQ ID NO: 2270 - RNA, 27 nt, Artificial Sequence
  Synthetic oligonucleotide
uuuaaagaagauguaauucaccagagc

SEQ ID NO: 2271 - RNA, 27 nt, Artificial Sequence
  Synthetic oligonucleotide
cuuuaaagaagauguaauucaccagag

SEQ ID NO: 2272 - RNA, 27 nt, Artificial Sequence
  Synthetic oligonucleotide
ccuuuaaagaagauguaauucaccaga

SEQ ID NO: 2273 - RNA, 27 nt, Artificial Sequence
  Synthetic oligonucleotide
gccuuuaaagaagauguaauucaccag

SEQ ID NO: 2274 - RNA, 27 nt, Artificial Sequence
  Synthetic oligonucleotide
ugccuuuaaagaagauguaauucacca

SEQ ID NO: 2275 - RNA, 27 nt, Artificial Sequence
  Synthetic oligonucleotide
uugccuuuaaagaagauguaauucacc

SEQ ID NO: 2276 - RNA, 27 nt, Artificial Sequence
  Synthetic oligonucleotide
uuugccuuuaaagaagauguaauucac

SEQ ID NO: 2277 - RNA, 27 nt, Artificial Sequence
  Synthetic oligonucleotide
auuugccuuuaaagaagauguaauuca

SEQ ID NO: 2278 - RNA, 27 nt, Artificial Sequence
  Synthetic oligonucleotide
cauuugccuuuaaagaagauguaauuc

SEQ ID NO: 2279 - RNA, 27 nt, Artificial Sequence
  Synthetic oligonucleotide
ccauuugccuuuaaagaagauguaauu

SEQ ID NO: 2280 - RNA, 27 nt, Artificial Sequence
  Synthetic oligonucleotide
cccauuugccuuuaaagaagauguaau

SEQ ID NO: 2281 - RNA, 27 nt, Artificial Sequence
  Synthetic oligonucleotide
ucccauuugccuuuaaagaagauguaa

SEQ ID NO: 2282 - RNA, 27 nt, Artificial Sequence
  Synthetic oligonucleotide
cucccauuugccuuuaaagaagaugua

SEQ ID NO: 2283 - RNA, 27 nt, Artificial Sequence
  Synthetic oligonucleotide
gucucucccauuugccuuuaaagaaga

SEQ ID NO: 2284 - RNA, 27 nt, Artificial Sequence
  Synthetic oligonucleotide
gggucucucccauuugccuuuaaagaa

SEQ ID NO: 2285 - RNA, 27 nt, Artificial Sequence
  Synthetic oligonucleotide
acuucaaagggucucucccauuugccu

SEQ ID NO: 2286 - RNA, 27 nt, Artificial Sequence
  Synthetic oligonucleotide
gacuucaaagggucucucccauuugcc

SEQ ID NO: 2287 - RNA, 27 nt, Artificial Sequence
  Synthetic oligonucleotide
ugacuucaaagggucucucccauuugc

SEQ ID NO: 2288 - RNA, 27 nt, Artificial Sequence
  Synthetic oligonucleotide
uugacuucaaagggucucucccauuug

SEQ ID NO: 2289 - RNA, 27 nt, Artificial Sequence
  Synthetic oligonucleotide
uucaucagcagcacccagcuggacagc

SEQ ID NO: 2290 - RNA, 27 nt, Artificial Sequence
  Synthetic oligonucleotide
uuucaucagcagcacccagcuggacag

SEQ ID NO: 2291 - RNA, 27 nt, Artificial Sequence
  Synthetic oligonucleotide
auuucaucagcagcacccagcuggaca

SEQ ID NO: 2292 - RNA, 27 nt, Artificial Sequence
  Synthetic oligonucleotide
uauuucaucagcagcacccagcuggac

SEQ ID NO: 2293 - RNA, 27 nt, Artificial Sequence
  Synthetic oligonucleotide
guauuucaucagcagcacccagcugga

SEQ ID NO: 2294 - RNA, 27 nt, Artificial Sequence
  Synthetic oligonucleotide
gguauuucaucagcagcacccagcugg

SEQ ID NO: 2295 - RNA, 27 nt, Artificial Sequence
  Synthetic oligonucleotide
agguauuucaucagcagcacccagcug

SEQ ID NO: 2296 - RNA, 27 nt, Artificial Sequence
  Synthetic oligonucleotide
cagguauuucaucagcagcacccagcu

SEQ ID NO: 2297 - RNA, 27 nt, Artificial Sequence
  Synthetic oligonucleotide
ccagguauuucaucagcagcacccagc

SEQ ID NO: 2298 - RNA, 27 nt, Artificial Sequence
  Synthetic oligonucleotide
cccagguauuucaucagcagcacccag

SEQ ID NO: 2299 - RNA, 27 nt, Artificial Sequence
  Synthetic oligonucleotide
ugcccagguauuucaucagcagcaccc

SEQ ID NO: 2300 - RNA, 27 nt, Artificial Sequence
  Synthetic oligonucleotide
uugcccagguauuucaucagcagcacc

SEQ ID NO: 2301 - RNA, 27 nt, Artificial Sequence
  Synthetic oligonucleotide
auugcccagguauuucaucagcagcac

SEQ ID NO: 2302 - RNA, 27 nt, Artificial Sequence
  Synthetic oligonucleotide
cauugcccagguauuucaucagcagca

SEQ ID NO: 2303 - RNA, 27 nt, Artificial Sequence
  Synthetic oligonucleotide
gcauugcccagguauuucaucagcagc

SEQ ID NO: 2304 - RNA, 27 nt, Artificial Sequence
  Synthetic oligonucleotide
ggcauugcccagguauuucaucagcag

SEQ ID NO: 2305 - RNA, 27 nt, Artificial Sequence
  Synthetic oligonucleotide
uggcauugcccagguauuucaucagca

SEQ ID NO: 2306 - RNA, 27 nt, Artificial Sequence
  Synthetic oligonucleotide
guggcauugcccagguauuucaucagc

SEQ ID NO: 2307 - RNA, 27 nt, Artificial Sequence
  Synthetic oligonucleotide
gguggcauugcccagguauuucaucag

SEQ ID NO: 2308 - RNA, 27 nt, Artificial Sequence
  Synthetic oligonucleotide
cgguggcauugcccagguauuucauca

SEQ ID NO: 2309 - RNA, 27 nt, Artificial Sequence
  Synthetic oligonucleotide
ggcgguggcauugcccagguauuucau

SEQ ID NO: 2310 - RNA, 27 nt, Artificial Sequence
  Synthetic oligonucleotide
gggugaguucauuuuccaggugcugua

SEQ ID NO: 2311 - RNA, 27 nt, Artificial Sequence
  Synthetic oligonucleotide
uaucgugggugaguucauuuuccaggu

SEQ ID NO: 2312 - RNA, 27 nt, Artificial Sequence
  Synthetic oligonucleotide
auaucgugggugaguucauuuuccagg

SEQ ID NO: 2313 - RNA, 27 nt, Artificial Sequence
  Synthetic oligonucleotide
uuuccaggaacuuggugaugauaucgu

SEQ ID NO: 2314 - RNA, 27 nt, Artificial Sequence
  Synthetic oligonucleotide
ucugucuucauuuuccaggaacuuggu

SEQ ID NO: 2315 - RNA, 27 nt, Artificial Sequence
  Synthetic oligonucleotide
uucagaucauagguuccaguaauggac

SEQ ID NO: 2316 - RNA, 27 nt, Artificial Sequence
  Synthetic oligonucleotide
cuucagaucauagguuccaguaaugga

SEQ ID NO: 2317 - RNA, 27 nt, Artificial Sequence
  Synthetic oligonucleotide
ucuucagaucauagguuccaguaaugg

SEQ ID NO: 2318 - RNA, 27 nt, Artificial Sequence
  Synthetic oligonucleotide
cucuucagaucauagguuccaguaaug

SEQ ID NO: 2319 - RNA, 27 nt, Artificial Sequence
  Synthetic oligonucleotide
gcucuucagaucauagguuccaguaau

SEQ ID NO: 2320 - RNA, 27 nt, Artificial Sequence
  Synthetic oligonucleotide
cgcucuucagaucauagguuccaguaa

SEQ ID NO: 2321 - RNA, 27 nt, Artificial Sequence
  Synthetic oligonucleotide
acgcucuucagaucauagguuccagua

SEQ ID NO: 2322 - RNA, 27 nt, Artificial Sequence
  Synthetic oligonucleotide
gacgcucuucagaucauagguuccagu

SEQ ID NO: 2323 - RNA, 27 nt, Artificial Sequence
  Synthetic oligonucleotide
ggacgcucuucagaucauagguuccag

SEQ ID NO: 2324 - RNA, 27 nt, Artificial Sequence
  Synthetic oligonucleotide
ccccauugcugaagaccuuagugaugc

SEQ ID NO: 2325 - RNA, 27 nt, Artificial Sequence
  Synthetic oligonucleotide
gccccauugcugaagaccuuagugaug

SEQ ID NO: 2326 - RNA, 27 nt, Artificial Sequence
  Synthetic oligonucleotide
agccccauugcugaagaccuuagugau

SEQ ID NO: 2327 - RNA, 27 nt, Artificial Sequence
  Synthetic oligonucleotide
ucagccccauugcugaagaccuuagug

SEQ ID NO: 2328 - RNA, 27 nt, Artificial Sequence
  Synthetic oligonucleotide
gucagccccauugcugaagaccuuagu

SEQ ID NO: 2329 - RNA, 27 nt, Artificial Sequence
  Synthetic oligonucleotide
uuaugcacggccuuggagagcuucagg

SEQ ID NO: 2330 - RNA, 27 nt, Artificial Sequence
  Synthetic oligonucleotide
cuuaugcacggccuuggagagcuucag

SEQ ID NO: 2331 - RNA, 27 nt, Artificial Sequence
  Synthetic oligonucleotide
ccuuaugcacggccuuggagagcuuca

SEQ ID NO: 2332 - RNA, 27 nt, Artificial Sequence
  Synthetic oligonucleotide
aaggguuuguugaacuugaccucgggg

SEQ ID NO: 2333 - RNA, 27 nt, Artificial Sequence
  Synthetic oligonucleotide
aaaggguuuguugaacuugaccucggg

SEQ ID NO: 2334 - RNA, 27 nt, Artificial Sequence
  Synthetic oligonucleotide
caaaggguuuguugaacuugaccucgg

SEQ ID NO: 2335 - RNA, 27 nt, Artificial Sequence
  Synthetic oligonucleotide
acaaaggguuuguugaacuugaccucg

SEQ ID NO: 2336 - RNA, 27 nt, Artificial Sequence
  Synthetic oligonucleotide
gacaaaggguuuguugaacuugaccuc

SEQ ID NO: 2337 - RNA, 27 nt, Artificial Sequence
  Synthetic oligonucleotide
agacaaaggguuuguugaacuugaccu

SEQ ID NO: 2338 - RNA, 27 nt, Artificial Sequence
  Synthetic oligonucleotide
aagacaaaggguuuguugaacuugacc

SEQ ID NO: 2339 - RNA, 27 nt, Artificial Sequence
  Synthetic oligonucleotide
gaagacaaaggguuuguugaacuugac

SEQ ID NO: 2340 - RNA, 27 nt, Artificial Sequence
  Synthetic oligonucleotide
agaagacaaaggguuuguugaacuuga

SEQ ID NO: 2341 - RNA, 27 nt, Artificial Sequence
  Synthetic oligonucleotide
aagaagacaaaggguuuguugaacuug

SEQ ID NO: 2342 - DNA, 27 bp, Artificial Sequence
  Synthetic oligonucleotide
ccccagggagatgctgcccagaagaca

SEQ ID NO: 2343 - DNA, 27 bp, Artificial Sequence
  Synthetic oligonucleotide
cccagggagatgctgcccagaagacag

SEQ ID NO: 2344 - DNA, 27 bp, Artificial Sequence
  Synthetic oligonucleotide
ccagggagatgctgcccagaagacaga

SEQ ID NO: 2345 - DNA, 27 bp, Artificial Sequence
  Synthetic oligonucleotide
cagggagatgctgcccagaagacagat

SEQ ID NO: 2346 - DNA, 27 bp, Artificial Sequence
  Synthetic oligonucleotide
agggagatgctgcccagaagacagata

SEQ ID NO: 2347 - DNA, 27 bp, Artificial Sequence
  Synthetic oligonucleotide
gggagatgctgcccagaagacagatac

SEQ ID NO: 2348 - DNA, 27 bp, Artificial Sequence
  Synthetic oligonucleotide
cagatacatcccaccatgatcaggatc

SEQ ID NO: 2349 - DNA, 27 bp, Artificial Sequence
  Synthetic oligonucleotide
agatacatcccaccatgatcaggatca

SEQ ID NO: 2350 - DNA, 27 bp, Artificial Sequence
  Synthetic oligonucleotide
gatacatcccaccatgatcaggatcac

SEQ ID NO: 2351 - DNA, 27 bp, Artificial Sequence
  Synthetic oligonucleotide
atacatcccaccatgatcaggatcacc

SEQ ID NO: 2352 - DNA, 27 bp, Artificial Sequence
  Synthetic oligonucleotide
acaccagtccaacagcaccaatatctt

SEQ ID NO: 2353 - DNA, 27 bp, Artificial Sequence
  Synthetic oligonucleotide
caccagtccaacagcaccaatatcttc

SEQ ID NO: 2354 - DNA, 27 bp, Artificial Sequence
  Synthetic oligonucleotide
accagtccaacagcaccaatatcttct

SEQ ID NO: 2355 - DNA, 27 bp, Artificial Sequence
  Synthetic oligonucleotide
ccagtccaacagcaccaatatcttctt

SEQ ID NO: 2356 - DNA, 27 bp, Artificial Sequence
  Synthetic oligonucleotide
cagtccaacagcaccaatatcttcttc

SEQ ID NO: 2357 - DNA, 27 bp, Artificial Sequence
  Synthetic oligonucleotide
agtccaacagcaccaatatcttcttct

SEQ ID NO: 2358 - DNA, 27 bp, Artificial Sequence
  Synthetic oligonucleotide
gtccaacagcaccaatatcttcttctc

SEQ ID NO: 2359 - DNA, 27 bp, Artificial Sequence
  Synthetic oligonucleotide
tccaacagcaccaatatcttcttctcc

SEQ ID NO: 2360 - DNA, 27 bp, Artificial Sequence
  Synthetic oligonucleotide
ccaacagcaccaatatcttcttctccc

SEQ ID NO: 2361 - DNA, 27 bp, Artificial Sequence
  Synthetic oligonucleotide
caacagcaccaatatcttcttctcccc

SEQ ID NO: 2362 - DNA, 27 bp, Artificial Sequence
  Synthetic oligonucleotide
aacagcaccaatatcttcttctcccca

SEQ ID NO: 2363 - DNA, 27 bp, Artificial Sequence
  Synthetic oligonucleotide
acagcaccaatatcttcttctccccag

SEQ ID NO: 2364 - DNA, 27 bp, Artificial Sequence
  Synthetic oligonucleotide
cagcaccaatatcttcttctccccagt

SEQ ID NO: 2365 - DNA, 27 bp, Artificial Sequence
  Synthetic oligonucleotide
agcaccaatatcttcttctccccagtg

SEQ ID NO: 2366 - DNA, 27 bp, Artificial Sequence
  Synthetic oligonucleotide
gcaccaatatcttcttctccccagtga

SEQ ID NO: 2367 - DNA, 27 bp, Artificial Sequence
  Synthetic oligonucleotide
tccccagtgagcatcgctacagccttt

SEQ ID NO: 2368 - DNA, 27 bp, Artificial Sequence
  Synthetic oligonucleotide
ccccagtgagcatcgctacagcctttg

SEQ ID NO: 2369 - DNA, 27 bp, Artificial Sequence
  Synthetic oligonucleotide
cccagtgagcatcgctacagcctttgc

SEQ ID NO: 2370 - DNA, 27 bp, Artificial Sequence
  Synthetic oligonucleotide
ccagtgagcatcgctacagcctttgca

SEQ ID NO: 2371 - DNA, 27 bp, Artificial Sequence
  Synthetic oligonucleotide
cagtgagcatcgctacagcctttgcaa

SEQ ID NO: 2372 - DNA, 27 bp, Artificial Sequence
  Synthetic oligonucleotide
agtgagcatcgctacagcctttgcaat

SEQ ID NO: 2373 - DNA, 27 bp, Artificial Sequence
  Synthetic oligonucleotide
gtgagcatcgctacagcctttgcaatg

SEQ ID NO: 2374 - DNA, 27 bp, Artificial Sequence
  Synthetic oligonucleotide
tgagcatcgctacagcctttgcaatgc

SEQ ID NO: 2375 - DNA, 27 bp, Artificial Sequence
  Synthetic oligonucleotide
gagcatcgctacagcctttgcaatgct

SEQ ID NO: 2376 - DNA, 27 bp, Artificial Sequence
  Synthetic oligonucleotide
agcatcgctacagcctttgcaatgctc

SEQ ID NO: 2377 - DNA, 27 bp, Artificial Sequence
  Synthetic oligonucleotide
gcatcgctacagcctttgcaatgctct

SEQ ID NO: 2378 - DNA, 27 bp, Artificial Sequence
  Synthetic oligonucleotide
catcgctacagcctttgcaatgctctc

SEQ ID NO: 2379 - DNA, 27 bp, Artificial Sequence
  Synthetic oligonucleotide
atcgctacagcctttgcaatgctctcc

SEQ ID NO: 2380 - DNA, 27 bp, Artificial Sequence
  Synthetic oligonucleotide
tcgctacagcctttgcaatgctctccc

SEQ ID NO: 2381 - DNA, 27 bp, Artificial Sequence
  Synthetic oligonucleotide
cgctacagcctttgcaatgctctccct

SEQ ID NO: 2382 - DNA, 27 bp, Artificial Sequence
  Synthetic oligonucleotide
gctacagcctttgcaatgctctccctg

SEQ ID NO: 2383 - DNA, 27 bp, Artificial Sequence
  Synthetic oligonucleotide
tccctggggaccaaggctgacactcac

SEQ ID NO: 2384 - DNA, 27 bp, Artificial Sequence
  Synthetic oligonucleotide
tggggaccaaggctgacactcacgatg

SEQ ID NO: 2385 - DNA, 27 bp, Artificial Sequence
  Synthetic oligonucleotide
ggggaccaaggctgacactcacgatga

SEQ ID NO: 2386 - DNA, 27 bp, Artificial Sequence
  Synthetic oligonucleotide
gggaccaaggctgacactcacgatgaa

SEQ ID NO: 2387 - DNA, 27 bp, Artificial Sequence
  Synthetic oligonucleotide
gatgaaatcctggagggcctgaatttc

SEQ ID NO: 2388 - DNA, 27 bp, Artificial Sequence
  Synthetic oligonucleotide
atgaaatcctggagggcctgaatttca

SEQ ID NO: 2389 - DNA, 27 bp, Artificial Sequence
  Synthetic oligonucleotide
gatccatgaaggcttccaggaactcct

SEQ ID NO: 2390 - DNA, 27 bp, Artificial Sequence
  Synthetic oligonucleotide
atccatgaaggcttccaggaactcctc

SEQ ID NO: 2391 - DNA, 27 bp, Artificial Sequence
  Synthetic oligonucleotide
ggggacaccgaagaggccaagaaacag

SEQ ID NO: 2392 - DNA, 27 bp, Artificial Sequence
  Synthetic oligonucleotide
gggacaccgaagaggccaagaaacaga

SEQ ID NO: 2393 - DNA, 27 bp, Artificial Sequence
  Synthetic oligonucleotide
ggacaccgaagaggccaagaaacagat

SEQ ID NO: 2394 - DNA, 27 bp, Artificial Sequence
  Synthetic oligonucleotide
gacaccgaagaggccaagaaacagatc

SEQ ID NO: 2395 - DNA, 27 bp, Artificial Sequence
  Synthetic oligonucleotide
acaccgaagaggccaagaaacagatca

SEQ ID NO: 2396 - DNA, 27 bp, Artificial Sequence
  Synthetic oligonucleotide
caccgaagaggccaagaaacagatcaa

SEQ ID NO: 2397 - DNA, 27 bp, Artificial Sequence
  Synthetic oligonucleotide
accgaagaggccaagaaacagatcaac

SEQ ID NO: 2398 - DNA, 27 bp, Artificial Sequence
  Synthetic oligonucleotide
ccgaagaggccaagaaacagatcaacg

SEQ ID NO: 2399 - DNA, 27 bp, Artificial Sequence
  Synthetic oligonucleotide
cgaagaggccaagaaacagatcaacga

SEQ ID NO: 2400 - DNA, 27 bp, Artificial Sequence
  Synthetic oligonucleotide
gaagaggccaagaaacagatcaacgat

SEQ ID NO: 2401 - DNA, 27 bp, Artificial Sequence
  Synthetic oligonucleotide
aagaggccaagaaacagatcaacgatt

SEQ ID NO: 2402 - DNA, 27 bp, Artificial Sequence
  Synthetic oligonucleotide
agaggccaagaaacagatcaacgatta

SEQ ID NO: 2403 - DNA, 27 bp, Artificial Sequence
  Synthetic oligonucleotide
gaggccaagaaacagatcaacgattac

SEQ ID NO: 2404 - DNA, 27 bp, Artificial Sequence
  Synthetic oligonucleotide
gtttttgctctggtgaattacatcttc

SEQ ID NO: 2405 - DNA, 27 bp, Artificial Sequence
  Synthetic oligonucleotide
tttttgctctggtgaattacatcttct

SEQ ID NO: 2406 - DNA, 27 bp, Artificial Sequence
  Synthetic oligonucleotide
ttttgctctggtgaattacatcttctt

SEQ ID NO: 2407 - DNA, 27 bp, Artificial Sequence
  Synthetic oligonucleotide
tttgctctggtgaattacatcttcttt

SEQ ID NO: 2408 - DNA, 27 bp, Artificial Sequence
  Synthetic oligonucleotide
ttgctctggtgaattacatcttcttta

SEQ ID NO: 2409 - DNA, 27 bp, Artificial Sequence
  Synthetic oligonucleotide
tgctctggtgaattacatcttctttaa

SEQ ID NO: 2410 - DNA, 27 bp, Artificial Sequence
  Synthetic oligonucleotide
gctctggtgaattacatcttctttaaa

SEQ ID NO: 2411 - DNA, 27 bp, Artificial Sequence
  Synthetic oligonucleotide
ctctggtgaattacatcttctttaaag

SEQ ID NO: 2412 - DNA, 27 bp, Artificial Sequence
  Synthetic oligonucleotide
tctggtgaattacatcttctttaaagg

SEQ ID NO: 2413 - DNA, 27 bp, Artificial Sequence
  Synthetic oligonucleotide
ctggtgaattacatcttctttaaaggc

SEQ ID NO: 2414 - DNA, 27 bp, Artificial Sequence
  Synthetic oligonucleotide
tggtgaattacatcttctttaaaggca

SEQ ID NO: 2415 - DNA, 27 bp, Artificial Sequence
  Synthetic oligonucleotide
ggtgaattacatcttctttaaaggcaa

SEQ ID NO: 2416 - DNA, 27 bp, Artificial Sequence
  Synthetic oligonucleotide
gtgaattacatcttctttaaaggcaaa

SEQ ID NO: 2417 - DNA, 27 bp, Artificial Sequence
  Synthetic oligonucleotide
tgaattacatcttctttaaaggcaaat

SEQ ID NO: 2418 - DNA, 27 bp, Artificial Sequence
  Synthetic oligonucleotide
gaattacatcttctttaaaggcaaatg

SEQ ID NO: 2419 - DNA, 27 bp, Artificial Sequence
  Synthetic oligonucleotide
aattacatcttctttaaaggcaaatgg

SEQ ID NO: 2420 - DNA, 27 bp, Artificial Sequence
  Synthetic oligonucleotide
attacatcttctttaaaggcaaatggg

SEQ ID NO: 2421 - DNA, 27 bp, Artificial Sequence
  Synthetic oligonucleotide
ttacatcttctttaaaggcaaatggga

SEQ ID NO: 2422 - DNA, 27 bp, Artificial Sequence
  Synthetic oligonucleotide
tacatcttctttaaaggcaaatgggag

SEQ ID NO: 2423 - DNA, 27 bp, Artificial Sequence
  Synthetic oligonucleotide
tcttctttaaaggcaaatgggagagac

SEQ ID NO: 2424 - DNA, 27 bp, Artificial Sequence
  Synthetic oligonucleotide
ttctttaaaggcaaatgggagagaccc

SEQ ID NO: 2425 - DNA, 27 bp, Artificial Sequence
  Synthetic oligonucleotide
aggcaaatgggagagaccctttgaagt

SEQ ID NO: 2426 - DNA, 27 bp, Artificial Sequence
  Synthetic oligonucleotide
ggcaaatgggagagaccctttgaagtc

SEQ ID NO: 2427 - DNA, 27 bp, Artificial Sequence
  Synthetic oligonucleotide
gcaaatgggagagaccctttgaagtca

SEQ ID NO: 2428 - DNA, 27 bp, Artificial Sequence
  Synthetic oligonucleotide
caaatgggagagaccctttgaagtcaa

SEQ ID NO: 2429 - DNA, 27 bp, Artificial Sequence
  Synthetic oligonucleotide
gctgtccagctgggtgctgctgatgaa

SEQ ID NO: 2430 - DNA, 27 bp, Artificial Sequence
  Synthetic oligonucleotide
ctgtccagctgggtgctgctgatgaaa

SEQ ID NO: 2431 - DNA, 27 bp, Artificial Sequence
  Synthetic oligonucleotide
tgtccagctgggtgctgctgatgaaat

SEQ ID NO: 2432 - DNA, 27 bp, Artificial Sequence
  Synthetic oligonucleotide
gtccagctgggtgctgctgatgaaata

SEQ ID NO: 2433 - DNA, 27 bp, Artificial Sequence
  Synthetic oligonucleotide
tccagctgggtgctgctgatgaaatac

SEQ ID NO: 2434 - DNA, 27 bp, Artificial Sequence
  Synthetic oligonucleotide
ccagctgggtgctgctgatgaaatacc

SEQ ID NO: 2435 - DNA, 27 bp, Artificial Sequence
  Synthetic oligonucleotide
cagctgggtgctgctgatgaaatacct

SEQ ID NO: 2436 - DNA, 27 bp, Artificial Sequence
  Synthetic oligonucleotide
agctgggtgctgctgatgaaatacctg

SEQ ID NO: 2437 - DNA, 27 bp, Artificial Sequence
  Synthetic oligonucleotide
gctgggtgctgctgatgaaatacctgg

SEQ ID NO: 2438 - DNA, 27 bp, Artificial Sequence
  Synthetic oligonucleotide
ctgggtgctgctgatgaaatacctggg

SEQ ID NO: 2439 - DNA, 27 bp, Artificial Sequence
  Synthetic oligonucleotide
gggtgctgctgatgaaatacctgggca

SEQ ID NO: 2440 - DNA, 27 bp, Artificial Sequence
  Synthetic oligonucleotide
ggtgctgctgatgaaatacctgggcaa

SEQ ID NO: 2441 - DNA, 27 bp, Artificial Sequence
  Synthetic oligonucleotide
gtgctgctgatgaaatacctgggcaat

SEQ ID NO: 2442 - DNA, 27 bp, Artificial Sequence
  Synthetic oligonucleotide
tgctgctgatgaaatacctgggcaatg

SEQ ID NO: 2443 - DNA, 27 bp, Artificial Sequence
  Synthetic oligonucleotide
gctgctgatgaaatacctgggcaatgc

SEQ ID NO: 2444 - DNA, 27 bp, Artificial Sequence
  Synthetic oligonucleotide
ctgctgatgaaatacctgggcaatgcc

SEQ ID NO: 2445 - DNA, 27 bp, Artificial Sequence
  Synthetic oligonucleotide
tgctgatgaaatacctgggcaatgcca

SEQ ID NO: 2446 - DNA, 27 bp, Artificial Sequence
  Synthetic oligonucleotide
gctgatgaaatacctgggcaatgccac

SEQ ID NO: 2447 - DNA, 27 bp, Artificial Sequence
  Synthetic oligonucleotide
ctgatgaaatacctgggcaatgccacc

SEQ ID NO: 2448 - DNA, 27 bp, Artificial Sequence
  Synthetic oligonucleotide
tgatgaaatacctgggcaatgccaccg

SEQ ID NO: 2449 - DNA, 27 bp, Artificial Sequence
  Synthetic oligonucleotide
atgaaatacctgggcaatgccaccgcc

SEQ ID NO: 2450 - DNA, 27 bp, Artificial Sequence
  Synthetic oligonucleotide
tacagcacctggaaaatgaactcaccc

SEQ ID NO: 2451 - DNA, 27 bp, Artificial Sequence
  Synthetic oligonucleotide
acctggaaaatgaactcacccacgata

SEQ ID NO: 2452 - DNA, 27 bp, Artificial Sequence
  Synthetic oligonucleotide
cctggaaaatgaactcacccacgatat

SEQ ID NO: 2453 - DNA, 27 bp, Artificial Sequence
  Synthetic oligonucleotide
acgatatcatcaccaagttcctggaaa

SEQ ID NO: 2454 - DNA, 27 bp, Artificial Sequence
  Synthetic oligonucleotide
accaagttcctggaaaatgaagacaga

SEQ ID NO: 2455 - DNA, 27 bp, Artificial Sequence
  Synthetic oligonucleotide
gtccattactggaacctatgatctgaa

SEQ ID NO: 2456 - DNA, 27 bp, Artificial Sequence
  Synthetic oligonucleotide
tccattactggaacctatgatctgaag

SEQ ID NO: 2457 - DNA, 27 bp, Artificial Sequence
  Synthetic oligonucleotide
ccattactggaacctatgatctgaaga

SEQ ID NO: 2458 - DNA, 27 bp, Artificial Sequence
  Synthetic oligonucleotide
cattactggaacctatgatctgaagag

SEQ ID NO: 2459 - DNA, 27 bp, Artificial Sequence
  Synthetic oligonucleotide
attactggaacctatgatctgaagagc

SEQ ID NO: 2460 - DNA, 27 bp, Artificial Sequence
  Synthetic oligonucleotide
ttactggaacctatgatctgaagagcg

SEQ ID NO: 2461 - DNA, 27 bp, Artificial Sequence
  Synthetic oligonucleotide
tactggaacctatgatctgaagagcgt

SEQ ID NO: 2462 - DNA, 27 bp, Artificial Sequence
  Synthetic oligonucleotide
actggaacctatgatctgaagagcgtc

SEQ ID NO: 2463 - DNA, 27 bp, Artificial Sequence
  Synthetic oligonucleotide
ctggaacctatgatctgaagagcgtcc

SEQ ID NO: 2464 - DNA, 27 bp, Artificial Sequence
  Synthetic oligonucleotide
gcatcactaaggtcttcagcaatgggg

SEQ ID NO: 2465 - DNA, 27 bp, Artificial Sequence
  Synthetic oligonucleotide
catcactaaggtcttcagcaatggggc

SEQ ID NO: 2466 - DNA, 27 bp, Artificial Sequence
  Synthetic oligonucleotide
atcactaaggtcttcagcaatggggct

SEQ ID NO: 2467 - DNA, 27 bp, Artificial Sequence
  Synthetic oligonucleotide
cactaaggtcttcagcaatggggctga

SEQ ID NO: 2468 - DNA, 27 bp, Artificial Sequence
  Synthetic oligonucleotide
actaaggtcttcagcaatggggctgac

SEQ ID NO: 2469 - DNA, 27 bp, Artificial Sequence
  Synthetic oligonucleotide
cctgaagctctccaaggccgtgcataa

SEQ ID NO: 2470 - DNA, 27 bp, Artificial Sequence
  Synthetic oligonucleotide
ctgaagctctccaaggccgtgcataag

SEQ ID NO: 2471 - DNA, 27 bp, Artificial Sequence
  Synthetic oligonucleotide
tgaagctctccaaggccgtgcataagg

SEQ ID NO: 2472 - DNA, 27 bp, Artificial Sequence
  Synthetic oligonucleotide
ccccgaggtcaagttcaacaaaccctt

SEQ ID NO: 2473 - DNA, 27 bp, Artificial Sequence
  Synthetic oligonucleotide
cccgaggtcaagttcaacaaacccttt

SEQ ID NO: 2474 - DNA, 27 bp, Artificial Sequence
  Synthetic oligonucleotide
ccgaggtcaagttcaacaaaccctttg

SEQ ID NO: 2475 - DNA, 27 bp, Artificial Sequence
  Synthetic oligonucleotide
cgaggtcaagttcaacaaaccctttgt

SEQ ID NO: 2476 - DNA, 27 bp, Artificial Sequence
  Synthetic oligonucleotide
gaggtcaagttcaacaaaccctttgtc

SEQ ID NO: 2477 - DNA, 27 bp, Artificial Sequence
  Synthetic oligonucleotide
aggtcaagttcaacaaaccctttgtct

SEQ ID NO: 2478 - DNA, 27 bp, Artificial Sequence
  Synthetic oligonucleotide
ggtcaagttcaacaaaccctttgtctt

SEQ ID NO: 2479 - DNA, 27 bp, Artificial Sequence
  Synthetic oligonucleotide
gtcaagttcaacaaaccctttgtcttc

SEQ ID NO: 2480 - DNA, 27 bp, Artificial Sequence
  Synthetic oligonucleotide
tcaagttcaacaaaccctttgtcttct

SEQ ID NO: 2481 - DNA, 27 bp, Artificial Sequence
  Synthetic oligonucleotide
caagttcaacaaaccctttgtcttctt

SEQ ID NO: 2482 - RNA, 25 nt, Artificial Sequence
  Synthetic oligonucleotide
ccagggagaugcugcccagaagaca

SEQ ID NO: 2483 - RNA, 25 nt, Artificial Sequence
  Synthetic oligonucleotide
cagggagaugcugcccagaagacag

SEQ ID NO: 2484 - RNA, 25 nt, Artificial Sequence
  Synthetic oligonucleotide
agggagaugcugcccagaagacaga

SEQ ID NO: 2485 - RNA, 25 nt, Artificial Sequence
  Synthetic oligonucleotide
gggagaugcugcccagaagacagau

SEQ ID NO: 2486 - RNA, 25 nt, Artificial Sequence
  Synthetic oligonucleotide
ggagaugcugcccagaagacagaua

SEQ ID NO: 2487 - RNA, 25 nt, Artificial Sequence
  Synthetic oligonucleotide
gagaugcugcccagaagacagauac

SEQ ID NO: 2488 - RNA, 25 nt, Artificial Sequence
  Synthetic oligonucleotide
gauacaucccaccaugaucaggauc

SEQ ID NO: 2489 - RNA, 25 nt, Artificial Sequence
  Synthetic oligonucleotide
auacaucccaccaugaucaggauca

SEQ ID NO: 2490 - RNA, 25 nt, Artificial Sequence
  Synthetic oligonucleotide
uacaucccaccaugaucaggaucac

SEQ ID NO: 2491 - RNA, 25 nt, Artificial Sequence
  Synthetic oligonucleotide
acaucccaccaugaucaggaucacc

SEQ ID NO: 2492 - RNA, 25 nt, Artificial Sequence
  Synthetic oligonucleotide
accaguccaacagcaccaauaucuu

SEQ ID NO: 2493 - RNA, 25 nt, Artificial Sequence
  Synthetic oligonucleotide
ccaguccaacagcaccaauaucuuc

SEQ ID NO: 2494 - RNA, 25 nt, Artificial Sequence
  Synthetic oligonucleotide
caguccaacagcaccaauaucuucu

SEQ ID NO: 2495 - RNA, 25 nt, Artificial Sequence
  Synthetic oligonucleotide
aguccaacagcaccaauaucuucuu

SEQ ID NO: 2496 - RNA, 25 nt, Artificial Sequence
  Synthetic oligonucleotide
guccaacagcaccaauaucuucuuc

SEQ ID NO: 2497 - RNA, 25 nt, Artificial Sequence
  Synthetic oligonucleotide
uccaacagcaccaauaucuucuucu

SEQ ID NO: 2498 - RNA, 25 nt, Artificial Sequence
  Synthetic oligonucleotide
ccaacagcaccaauaucuucuucuc

SEQ ID NO: 2499 - RNA, 25 nt, Artificial Sequence
  Synthetic oligonucleotide
caacagcaccaauaucuucuucucc

SEQ ID NO: 2500 - RNA, 25 nt, Artificial Sequence
  Synthetic oligonucleotide
aacagcaccaauaucuucuucuccc

SEQ ID NO: 2501 - RNA, 25 nt, Artificial Sequence
  Synthetic oligonucleotide
acagcaccaauaucuucuucucccc

SEQ ID NO: 2502 - RNA, 25 nt, Artificial Sequence
  Synthetic oligonucleotide
cagcaccaauaucuucuucucccca

SEQ ID NO: 2503 - RNA, 25 nt, Artificial Sequence
  Synthetic oligonucleotide
agcaccaauaucuucuucuccccag

SEQ ID NO: 2504 - RNA, 25 nt, Artificial Sequence
  Synthetic oligonucleotide
gcaccaauaucuucuucuccccagu

SEQ ID NO: 2505 - RNA, 25 nt, Artificial Sequence
  Synthetic oligonucleotide
caccaauaucuucuucuccccagug

SEQ ID NO: 2506 - RNA, 25 nt, Artificial Sequence
  Synthetic oligonucleotide
accaauaucuucuucuccccaguga

SEQ ID NO: 2507 - RNA, 25 nt, Artificial Sequence
  Synthetic oligonucleotide
cccagugagcaucgcuacagccuuu

SEQ ID NO: 2508 - RNA, 25 nt, Artificial Sequence
  Synthetic oligonucleotide
ccagugagcaucgcuacagccuuug

SEQ ID NO: 2509 - RNA, 25 nt, Artificial Sequence
  Synthetic oligonucleotide
cagugagcaucgcuacagccuuugc

SEQ ID NO: 2510 - RNA, 25 nt, Artificial Sequence
  Synthetic oligonucleotide
agugagcaucgcuacagccuuugca

SEQ ID NO: 2511 - RNA, 25 nt, Artificial Sequence
  Synthetic oligonucleotide
gugagcaucgcuacagccuuugcaa

SEQ ID NO: 2512 - RNA, 25 nt, Artificial Sequence
  Synthetic oligonucleotide
ugagcaucgcuacagccuuugcaau

SEQ ID NO: 2513 - RNA, 25 nt, Artificial Sequence
  Synthetic oligonucleotide
gagcaucgcuacagccuuugcaaug

SEQ ID NO: 2514 - RNA, 25 nt, Artificial Sequence
  Synthetic oligonucleotide
agcaucgcuacagccuuugcaaugc

SEQ ID NO: 2515 - RNA, 25 nt, Artificial Sequence
  Synthetic oligonucleotide
gcaucgcuacagccuuugcaaugcu

SEQ ID NO: 2516 - RNA, 25 nt, Artificial Sequence
  Synthetic oligonucleotide
caucgcuacagccuuugcaaugcuc

SEQ ID NO: 2517 - RNA, 25 nt, Artificial Sequence
  Synthetic oligonucleotide
aucgcuacagccuuugcaaugcucu

SEQ ID NO: 2518 - RNA, 25 nt, Artificial Sequence
  Synthetic oligonucleotide
ucgcuacagccuuugcaaugcucuc

SEQ ID NO: 2519 - RNA, 25 nt, Artificial Sequence
  Synthetic oligonucleotide
cgcuacagccuuugcaaugcucucc

SEQ ID NO: 2520 - RNA, 25 nt, Artificial Sequence
  Synthetic oligonucleotide
gcuacagccuuugcaaugcucuccc

SEQ ID NO: 2521 - RNA, 25 nt, Artificial Sequence
  Synthetic oligonucleotide
cuacagccuuugcaaugcucucccu

SEQ ID NO: 2522 - RNA, 25 nt, Artificial Sequence
  Synthetic oligonucleotide
uacagccuuugcaaugcucucccug

SEQ ID NO: 2523 - RNA, 25 nt, Artificial Sequence
  Synthetic oligonucleotide
ccuggggaccaaggcugacacucac

SEQ ID NO: 2524 - RNA, 25 nt, Artificial Sequence
  Synthetic oligonucleotide
gggaccaaggcugacacucacgaug

SEQ ID NO: 2525 - RNA, 25 nt, Artificial Sequence
  Synthetic oligonucleotide
ggaccaaggcugacacucacgauga

SEQ ID NO: 2526 - RNA, 25 nt, Artificial Sequence
  Synthetic oligonucleotide
gaccaaggcugacacucacgaugaa

SEQ ID NO: 2527 - RNA, 25 nt, Artificial Sequence
  Synthetic oligonucleotide
ugaaauccuggagggccugaauuuc

SEQ ID NO: 2528 - RNA, 25 nt, Artificial Sequence
  Synthetic oligonucleotide
gaaauccuggagggccugaauuuca

SEQ ID NO: 2529 - RNA, 25 nt, Artificial Sequence
  Synthetic oligonucleotide
uccaugaaggcuuccaggaacuccu

SEQ ID NO: 2530 - RNA, 25 nt, Artificial Sequence
  Synthetic oligonucleotide
ccaugaaggcuuccaggaacuccuc

SEQ ID NO: 2531 - RNA, 25 nt, Artificial Sequence
  Synthetic oligonucleotide
ggacaccgaagaggccaagaaacag

SEQ ID NO: 2532 - RNA, 25 nt, Artificial Sequence
  Synthetic oligonucleotide
gacaccgaagaggccaagaaacaga

SEQ ID NO: 2533 - RNA, 25 nt, Artificial Sequence
  Synthetic oligonucleotide
acaccgaagaggccaagaaacagau

SEQ ID NO: 2534 - RNA, 25 nt, Artificial Sequence
  Synthetic oligonucleotide
caccgaagaggccaagaaacagauc

SEQ ID NO: 2535 - RNA, 25 nt, Artificial Sequence
  Synthetic oligonucleotide
accgaagaggccaagaaacagauca

SEQ ID NO: 2536 - RNA, 25 nt, Artificial Sequence
  Synthetic oligonucleotide
ccgaagaggccaagaaacagaucaa

SEQ ID NO: 2537 - RNA, 25 nt, Artificial Sequence
  Synthetic oligonucleotide
cgaagaggccaagaaacagaucaac

SEQ ID NO: 2538 - RNA, 25 nt, Artificial Sequence
  Synthetic oligonucleotide
gaagaggccaagaaacagaucaacg

SEQ ID NO: 2539 - RNA, 25 nt, Artificial Sequence
  Synthetic oligonucleotide
aagaggccaagaaacagaucaacga

SEQ ID NO: 2540 - RNA, 25 nt, Artificial Sequence
  Synthetic oligonucleotide
agaggccaagaaacagaucaacgau

SEQ ID NO: 2541 - RNA, 25 nt, Artificial Sequence
  Synthetic oligonucleotide
gaggccaagaaacagaucaacgauu

SEQ ID NO: 2542 - RNA, 25 nt, Artificial Sequence
  Synthetic oligonucleotide
aggccaagaaacagaucaacgauua

SEQ ID NO: 2543 - RNA, 25 nt, Artificial Sequence
  Synthetic oligonucleotide
ggccaagaaacagaucaacgauuac

SEQ ID NO: 2544 - RNA, 25 nt, Artificial Sequence
  Synthetic oligonucleotide
uuuugcucuggugaauuacaucuuc

SEQ ID NO: 2545 - RNA, 25 nt, Artificial Sequence
  Synthetic oligonucleotide
uuugcucuggugaauuacaucuucu

SEQ ID NO: 2546 - RNA, 25 nt, Artificial Sequence
  Synthetic oligonucleotide
uugcucuggugaauuacaucuucuu

SEQ ID NO: 2547 - RNA, 25 nt, Artificial Sequence
  Synthetic oligonucleotide
ugcucuggugaauuacaucuucuuu

SEQ ID NO: 2548 - RNA, 25 nt, Artificial Sequence
  Synthetic oligonucleotide
gcucuggugaauuacaucuucuuua

SEQ ID NO: 2549 - RNA, 25 nt, Artificial Sequence
  Synthetic oligonucleotide
cucuggugaauuacaucuucuuuaa

SEQ ID NO: 2550 - RNA, 25 nt, Artificial Sequence
  Synthetic oligonucleotide
ucuggugaauuacaucuucuuuaaa

SEQ ID NO: 2551 - RNA, 25 nt, Artificial Sequence
  Synthetic oligonucleotide
cuggugaauuacaucuucuuuaaag

SEQ ID NO: 2552 - RNA, 25 nt, Artificial Sequence
  Synthetic oligonucleotide
uggugaauuacaucuucuuuaaagg

SEQ ID NO: 2553 - RNA, 25 nt, Artificial Sequence
  Synthetic oligonucleotide
ggugaauuacaucuucuuuaaaggc

SEQ ID NO: 2554 - RNA, 25 nt, Artificial Sequence
  Synthetic oligonucleotide
gugaauuacaucuucuuuaaaggca

SEQ ID NO: 2555 - RNA, 25 nt, Artificial Sequence
  Synthetic oligonucleotide
ugaauuacaucuucuuuaaaggcaa

SEQ ID NO: 2556 - RNA, 25 nt, Artificial Sequence
  Synthetic oligonucleotide
gaauuacaucuucuuuaaaggcaaa

SEQ ID NO: 2557 - RNA, 25 nt, Artificial Sequence
  Synthetic oligonucleotide
aauuacaucuucuuuaaaggcaaau

SEQ ID NO: 2558 - RNA, 25 nt, Artificial Sequence
  Synthetic oligonucleotide
auuacaucuucuuuaaaggcaaaug

SEQ ID NO: 2559 - RNA, 25 nt, Artificial Sequence
  Synthetic oligonucleotide
uuacaucuucuuuaaaggcaaaugg

SEQ ID NO: 2560 - RNA, 25 nt, Artificial Sequence
  Synthetic oligonucleotide
uacaucuucuuuaaaggcaaauggg

SEQ ID NO: 2561 - RNA, 25 nt, Artificial Sequence
  Synthetic oligonucleotide
acaucuucuuuaaaggcaaauggga

SEQ ID NO: 2562 - RNA, 25 nt, Artificial Sequence
  Synthetic oligonucleotide
caucuucuuuaaaggcaaaugggag

SEQ ID NO: 2563 - RNA, 25 nt, Artificial Sequence
  Synthetic oligonucleotide
uucuuuaaaggcaaaugggagagac

SEQ ID NO: 2564 - RNA, 25 nt, Artificial Sequence
  Synthetic oligonucleotide
cuuuaaaggcaaaugggagagaccc

SEQ ID NO: 2565 - RNA, 25 nt, Artificial Sequence
  Synthetic oligonucleotide
gcaaaugggagagacccuuugaagu

SEQ ID NO: 2566 - RNA, 25 nt, Artificial Sequence
  Synthetic oligonucleotide
caaaugggagagacccuuugaaguc

SEQ ID NO: 2567 - RNA, 25 nt, Artificial Sequence
  Synthetic oligonucleotide
aaaugggagagacccuuugaaguca

SEQ ID NO: 2568 - RNA, 25 nt, Artificial Sequence
  Synthetic oligonucleotide
aaugggagagacccuuugaagucaa

SEQ ID NO: 2569 - RNA, 25 nt, Artificial Sequence
  Synthetic oligonucleotide
uguccagcugggugcugcugaugaa

SEQ ID NO: 2570 - RNA, 25 nt, Artificial Sequence
  Synthetic oligonucleotide
guccagcugggugcugcugaugaaa

SEQ ID NO: 2571 - RNA, 25 nt, Artificial Sequence
  Synthetic oligonucleotide
uccagcugggugcugcugaugaaau

SEQ ID NO: 2572 - RNA, 25 nt, Artificial Sequence
  Synthetic oligonucleotide
ccagcugggugcugcugaugaaaua

SEQ ID NO: 2573 - RNA, 25 nt, Artificial Sequence
  Synthetic oligonucleotide
cagcugggugcugcugaugaaauac

SEQ ID NO: 2574 - RNA, 25 nt, Artificial Sequence
  Synthetic oligonucleotide
agcugggugcugcugaugaaauacc

SEQ ID NO: 2575 - RNA, 25 nt, Artificial Sequence
  Synthetic oligonucleotide
gcugggugcugcugaugaaauaccu

SEQ ID NO: 2576 - RNA, 25 nt, Artificial Sequence
  Synthetic oligonucleotide
cugggugcugcugaugaaauaccug

SEQ ID NO: 2577 - RNA, 25 nt, Artificial Sequence
  Synthetic oligonucleotide
ugggugcugcugaugaaauaccugg

SEQ ID NO: 2578 - RNA, 25 nt, Artificial Sequence
  Synthetic oligonucleotide
gggugcugcugaugaaauaccuggg

SEQ ID NO: 2579 - RNA, 25 nt, Artificial Sequence
  Synthetic oligonucleotide
gugcugcugaugaaauaccugggca

SEQ ID NO: 2580 - RNA, 25 nt, Artificial Sequence
  Synthetic oligonucleotide
ugcugcugaugaaauaccugggcaa

SEQ ID NO: 2581 - RNA, 25 nt, Artificial Sequence
  Synthetic oligonucleotide
gcugcugaugaaauaccugggcaau

SEQ ID NO: 2582 - RNA, 25 nt, Artificial Sequence
  Synthetic oligonucleotide
cugcugaugaaauaccugggcaaug

SEQ ID NO: 2583 - RNA, 25 nt, Artificial Sequence
  Synthetic oligonucleotide
ugcugaugaaauaccugggcaaugc

SEQ ID NO: 2584 - RNA, 25 nt, Artificial Sequence
  Synthetic oligonucleotide
gcugaugaaauaccugggcaaugcc

SEQ ID NO: 2585 - RNA, 25 nt, Artificial Sequence
  Synthetic oligonucleotide
cugaugaaauaccugggcaaugcca

SEQ ID NO: 2586 - RNA, 25 nt, Artificial Sequence
  Synthetic oligonucleotide
ugaugaaauaccugggcaaugccac

SEQ ID NO: 2587 - RNA, 25 nt, Artificial Sequence
  Synthetic oligonucleotide
gaugaaauaccugggcaaugccacc

SEQ ID NO: 2588 - RNA, 25 nt, Artificial Sequence
  Synthetic oligonucleotide
augaaauaccugggcaaugccaccg

SEQ ID NO: 2589 - RNA, 25 nt, Artificial Sequence
  Synthetic oligonucleotide
gaaauaccugggcaaugccaccgcc

SEQ ID NO: 2590 - RNA, 25 nt, Artificial Sequence
  Synthetic oligonucleotide
cagcaccuggaaaaugaacucaccc

SEQ ID NO: 2591 - RNA, 25 nt, Artificial Sequence
  Synthetic oligonucleotide
cuggaaaaugaacucacccacgaua

SEQ ID NO: 2592 - RNA, 25 nt, Artificial Sequence
  Synthetic oligonucleotide
uggaaaaugaacucacccacgauau

SEQ ID NO: 2593 - RNA, 25 nt, Artificial Sequence
  Synthetic oligonucleotide
gauaucaucaccaaguuccuggaaa

SEQ ID NO: 2594 - RNA, 25 nt, Artificial Sequence
  Synthetic oligonucleotide
caaguuccuggaaaaugaagacaga

SEQ ID NO: 2595 - RNA, 25 nt, Artificial Sequence
  Synthetic oligonucleotide
ccauuacuggaaccuaugaucugaa

SEQ ID NO: 2596 - RNA, 25 nt, Artificial Sequence
  Synthetic oligonucleotide
cauuacuggaaccuaugaucugaag

SEQ ID NO: 2597 - RNA, 25 nt, Artificial Sequence
  Synthetic oligonucleotide
auuacuggaaccuaugaucugaaga

SEQ ID NO: 2598 - RNA, 25 nt, Artificial Sequence
  Synthetic oligonucleotide
uuacuggaaccuaugaucugaagag

SEQ ID NO: 2599 - RNA, 25 nt, Artificial Sequence
  Synthetic oligonucleotide
uacuggaaccuaugaucugaagagc

SEQ ID NO: 2600 - RNA, 25 nt, Artificial Sequence
  Synthetic oligonucleotide
acuggaaccuaugaucugaagagcg

SEQ ID NO: 2601 - RNA, 25 nt, Artificial Sequence
  Synthetic oligonucleotide
cuggaaccuaugaucugaagagcgu

SEQ ID NO: 2602 - RNA, 25 nt, Artificial Sequence
  Synthetic oligonucleotide
uggaaccuaugaucugaagagcguc

SEQ ID NO: 2603 - RNA, 25 nt, Artificial Sequence
  Synthetic oligonucleotide
ggaaccuaugaucugaagagcgucc

SEQ ID NO: 2604 - RNA, 25 nt, Artificial Sequence
  Synthetic oligonucleotide
aucacuaaggucuucagcaaugggg

SEQ ID NO: 2605 - RNA, 25 nt, Artificial Sequence
  Synthetic oligonucleotide
ucacuaaggucuucagcaauggggc

SEQ ID NO: 2606 - RNA, 25 nt, Artificial Sequence
  Synthetic oligonucleotide
cacuaaggucuucagcaauggggcu

SEQ ID NO: 2607 - RNA, 25 nt, Artificial Sequence
  Synthetic oligonucleotide
cuaaggucuucagcaauggggcuga

SEQ ID NO: 2608 - RNA, 25 nt, Artificial Sequence
  Synthetic oligonucleotide
uaaggucuucagcaauggggcugac

SEQ ID NO: 2609 - RNA, 25 nt, Artificial Sequence
  Synthetic oligonucleotide
ugaagcucuccaaggccgugcauaa

SEQ ID NO: 2610 - RNA, 25 nt, Artificial Sequence
  Synthetic oligonucleotide
gaagcucuccaaggccgugcauaag

SEQ ID NO: 2611 - RNA, 25 nt, Artificial Sequence
  Synthetic oligonucleotide
aagcucuccaaggccgugcauaagg

SEQ ID NO: 2612 - RNA, 25 nt, Artificial Sequence
  Synthetic oligonucleotide
ccgaggucaaguucaacaaacccuu

SEQ ID NO: 2613 - RNA, 25 nt, Artificial Sequence
  Synthetic oligonucleotide
cgaggucaaguucaacaaacccuuu

SEQ ID NO: 2614 - RNA, 25 nt, Artificial Sequence
  Synthetic oligonucleotide
gaggucaaguucaacaaacccuuug

SEQ ID NO: 2615 - RNA, 25 nt, Artificial Sequence
  Synthetic oligonucleotide
aggucaaguucaacaaacccuuugu

SEQ ID NO: 2616 - RNA, 25 nt, Artificial Sequence
  Synthetic oligonucleotide
ggucaaguucaacaaacccuuuguc

SEQ ID NO: 2617 - RNA, 25 nt, Artificial Sequence
  Synthetic oligonucleotide
gucaaguucaacaaacccuuugucu

SEQ ID NO: 2618 - RNA, 25 nt, Artificial Sequence
  Synthetic oligonucleotide
ucaaguucaacaaacccuuugucuu

SEQ ID NO: 2619 - RNA, 25 nt, Artificial Sequence
  Synthetic oligonucleotide
caaguucaacaaacccuuugucuuc

SEQ ID NO: 2620 - RNA, 25 nt, Artificial Sequence
  Synthetic oligonucleotide
aaguucaacaaacccuuugucuucu

SEQ ID NO: 2621 - RNA, 25 nt, Artificial Sequence
  Synthetic oligonucleotide
aguucaacaaacccuuugucuucuu

SEQ ID NO: 2622 - RNA, 21 nt, Artificial Sequence
  Synthetic oligonucleotide
ccccagggagaugcugcccag

SEQ ID NO: 2623 - RNA, 21 nt, Artificial Sequence
  Synthetic oligonucleotide
cccagggagaugcugcccaga

SEQ ID NO: 2624 - RNA, 21 nt, Artificial Sequence
  Synthetic oligonucleotide
ccagggagaugcugcccagaa

SEQ ID NO: 2625 - RNA, 21 nt, Artificial Sequence
  Synthetic oligonucleotide
cagggagaugcugcccagaag

SEQ ID NO: 2626 - RNA, 21 nt, Artificial Sequence
  Synthetic oligonucleotide
agggagaugcugcccagaaga

SEQ ID NO: 2627 - RNA, 21 nt, Artificial Sequence
  Synthetic oligonucleotide
gggagaugcugcccagaagac

SEQ ID NO: 2628 - RNA, 21 nt, Artificial Sequence
  Synthetic oligonucleotide
cagauacaucccaccaugauc

SEQ ID NO: 2629 - RNA, 21 nt, Artificial Sequence
  Synthetic oligonucleotide
agauacaucccaccaugauca

SEQ ID NO: 2630 - RNA, 21 nt, Artificial Sequence
  Synthetic oligonucleotide
gauacaucccaccaugaucag

SEQ ID NO: 2631 - RNA, 21 nt, Artificial Sequence
  Synthetic oligonucleotide
auacaucccaccaugaucagg

SEQ ID NO: 2632 - RNA, 21 nt, Artificial Sequence
  Synthetic oligonucleotide
acaccaguccaacagcaccaa

SEQ ID NO: 2633 - RNA, 21 nt, Artificial Sequence
  Synthetic oligonucleotide
caccaguccaacagcaccaau

SEQ ID NO: 2634 - RNA, 21 nt, Artificial Sequence
  Synthetic oligonucleotide
accaguccaacagcaccaaua

SEQ ID NO: 2635 - RNA, 21 nt, Artificial Sequence
  Synthetic oligonucleotide
ccaguccaacagcaccaauau

SEQ ID NO: 2636 - RNA, 21 nt, Artificial Sequence
  Synthetic oligonucleotide
caguccaacagcaccaauauc

SEQ ID NO: 2637 - RNA, 21 nt, Artificial Sequence
  Synthetic oligonucleotide
aguccaacagcaccaauaucu

SEQ ID NO: 2638 - RNA, 21 nt, Artificial Sequence
  Synthetic oligonucleotide
guccaacagcaccaauaucuu

SEQ ID NO: 2639 - RNA, 21 nt, Artificial Sequence
  Synthetic oligonucleotide
uccaacagcaccaauaucuuc

SEQ ID NO: 2640 - RNA, 21 nt, Artificial Sequence
  Synthetic oligonucleotide
ccaacagcaccaauaucuucu

SEQ ID NO: 2641 - RNA, 21 nt, Artificial Sequence
  Synthetic oligonucleotide
caacagcaccaauaucuucuu

SEQ ID NO: 2642 - RNA, 21 nt, Artificial Sequence
  Synthetic oligonucleotide
aacagcaccaauaucuucuuc

SEQ ID NO: 2643 - RNA, 21 nt, Artificial Sequence
  Synthetic oligonucleotide
acagcaccaauaucuucuucu

SEQ ID NO: 2644 - RNA, 21 nt, Artificial Sequence
  Synthetic oligonucleotide
cagcaccaauaucuucuucuc

SEQ ID NO: 2645 - RNA, 21 nt, Artificial Sequence
  Synthetic oligonucleotide
agcaccaauaucuucuucucc

SEQ ID NO: 2646 - RNA, 21 nt, Artificial Sequence
  Synthetic oligonucleotide
gcaccaauaucuucuucuccc

SEQ ID NO: 2647 - RNA, 21 nt, Artificial Sequence
  Synthetic oligonucleotide
uccccagugagcaucgcuaca

SEQ ID NO: 2648 - RNA, 21 nt, Artificial Sequence
  Synthetic oligonucleotide
ccccagugagcaucgcuacag

SEQ ID NO: 2649 - RNA, 21 nt, Artificial Sequence
  Synthetic oligonucleotide
cccagugagcaucgcuacagc

SEQ ID NO: 2650 - RNA, 21 nt, Artificial Sequence
  Synthetic oligonucleotide
ccagugagcaucgcuacagcc

SEQ ID NO: 2651 - RNA, 21 nt, Artificial Sequence
  Synthetic oligonucleotide
cagugagcaucgcuacagccu

SEQ ID NO: 2652 - RNA, 21 nt, Artificial Sequence
  Synthetic oligonucleotide
agugagcaucgcuacagccuu

SEQ ID NO: 2653 - RNA, 21 nt, Artificial Sequence
  Synthetic oligonucleotide
gugagcaucgcuacagccuuu

SEQ ID NO: 2654 - RNA, 21 nt, Artificial Sequence
  Synthetic oligonucleotide
ugagcaucgcuacagccuuug

SEQ ID NO: 2655 - RNA, 21 nt, Artificial Sequence
  Synthetic oligonucleotide
gagcaucgcuacagccuuugc

SEQ ID NO: 2656 - RNA, 21 nt, Artificial Sequence
  Synthetic oligonucleotide
agcaucgcuacagccuuugca

SEQ ID NO: 2657 - RNA, 21 nt, Artificial Sequence
  Synthetic oligonucleotide
gcaucgcuacagccuuugcaa

SEQ ID NO: 2658 - RNA, 21 nt, Artificial Sequence
  Synthetic oligonucleotide
caucgcuacagccuuugcaau

SEQ ID NO: 2659 - RNA, 21 nt, Artificial Sequence
  Synthetic oligonucleotide
aucgcuacagccuuugcaaug

SEQ ID NO: 2660 - RNA, 21 nt, Artificial Sequence
  Synthetic oligonucleotide
ucgcuacagccuuugcaaugc

SEQ ID NO: 2661 - RNA, 21 nt, Artificial Sequence
  Synthetic oligonucleotide
cgcuacagccuuugcaaugcu

SEQ ID NO: 2662 - RNA, 21 nt, Artificial Sequence
  Synthetic oligonucleotide
gcuacagccuuugcaaugcuc

SEQ ID NO: 2663 - RNA, 21 nt, Artificial Sequence
  Synthetic oligonucleotide
ucccuggggaccaaggcugac

SEQ ID NO: 2664 - RNA, 21 nt, Artificial Sequence
  Synthetic oligonucleotide
uggggaccaaggcugacacuc

SEQ ID NO: 2665 - RNA, 21 nt, Artificial Sequence
  Synthetic oligonucleotide
ggggaccaaggcugacacuca

SEQ ID NO: 2666 - RNA, 21 nt, Artificial Sequence
  Synthetic oligonucleotide
gggaccaaggcugacacucac

SEQ ID NO: 2667 - RNA, 21 nt, Artificial Sequence
  Synthetic oligonucleotide
gaugaaauccuggagggccug

SEQ ID NO: 2668 - RNA, 21 nt, Artificial Sequence
  Synthetic oligonucleotide
augaaauccuggagggccuga

SEQ ID NO: 2669 - RNA, 21 nt, Artificial Sequence
  Synthetic oligonucleotide
gauccaugaaggcuuccagga

SEQ ID NO: 2670 - RNA, 21 nt, Artificial Sequence
  Synthetic oligonucleotide
auccaugaaggcuuccaggaa

SEQ ID NO: 2671 - RNA, 21 nt, Artificial Sequence
  Synthetic oligonucleotide
ggggacaccgaagaggccaag

SEQ ID NO: 2672 - RNA, 21 nt, Artificial Sequence
  Synthetic oligonucleotide
gggacaccgaagaggccaaga

SEQ ID NO: 2673 - RNA, 21 nt, Artificial Sequence
  Synthetic oligonucleotide
ggacaccgaagaggccaagaa

SEQ ID NO: 2674 - RNA, 21 nt, Artificial Sequence
  Synthetic oligonucleotide
gacaccgaagaggccaagaaa

SEQ ID NO: 2675 - RNA, 21 nt, Artificial Sequence
  Synthetic oligonucleotide
acaccgaagaggccaagaaac

SEQ ID NO: 2676 - RNA, 21 nt, Artificial Sequence
  Synthetic oligonucleotide
caccgaagaggccaagaaaca

SEQ ID NO: 2677 - RNA, 21 nt, Artificial Sequence
  Synthetic oligonucleotide
accgaagaggccaagaaacag

SEQ ID NO: 2678 - RNA, 21 nt, Artificial Sequence
  Synthetic oligonucleotide
ccgaagaggccaagaaacaga

SEQ ID NO: 2679 - RNA, 21 nt, Artificial Sequence
  Synthetic oligonucleotide
cgaagaggccaagaaacagau

SEQ ID NO: 2680 - RNA, 21 nt, Artificial Sequence
  Synthetic oligonucleotide
gaagaggccaagaaacagauc

SEQ ID NO: 2681 - RNA, 21 nt, Artificial Sequence
  Synthetic oligonucleotide
aagaggccaagaaacagauca

SEQ ID NO: 2682 - RNA, 21 nt, Artificial Sequence
  Synthetic oligonucleotide
agaggccaagaaacagaucaa

SEQ ID NO: 2683 - RNA, 21 nt, Artificial Sequence
  Synthetic oligonucleotide
gaggccaagaaacagaucaac

SEQ ID NO: 2684 - RNA, 21 nt, Artificial Sequence
  Synthetic oligonucleotide
guuuuugcucuggugaauuac

SEQ ID NO: 2685 - RNA, 21 nt, Artificial Sequence
  Synthetic oligonucleotide
uuuuugcucuggugaauuaca

SEQ ID NO: 2686 - RNA, 21 nt, Artificial Sequence
  Synthetic oligonucleotide
uuuugcucuggugaauuacau

SEQ ID NO: 2687 - RNA, 21 nt, Artificial Sequence
  Synthetic oligonucleotide
uuugcucuggugaauuacauc

SEQ ID NO: 2688 - RNA, 21 nt, Artificial Sequence
  Synthetic oligonucleotide
uugcucuggugaauuacaucu

SEQ ID NO: 2689 - RNA, 21 nt, Artificial Sequence
  Synthetic oligonucleotide
ugcucuggugaauuacaucuu

SEQ ID NO: 2690 - RNA, 21 nt, Artificial Sequence
  Synthetic oligonucleotide
gcucuggugaauuacaucuuc

SEQ ID NO: 2691 - RNA, 21 nt, Artificial Sequence
  Synthetic oligonucleotide
cucuggugaauuacaucuucu

SEQ ID NO: 2692 - RNA, 21 nt, Artificial Sequence
  Synthetic oligonucleotide
ucuggugaauuacaucuucuu

SEQ ID NO: 2693 - RNA, 21 nt, Artificial Sequence
  Synthetic oligonucleotide
cuggugaauuacaucuucuuu

SEQ ID NO: 2694 - RNA, 21 nt, Artificial Sequence
  Synthetic oligonucleotide
uggugaauuacaucuucuuua

SEQ ID NO: 2695 - RNA, 21 nt, Artificial Sequence
  Synthetic oligonucleotide
ggugaauuacaucuucuuuaa

SEQ ID NO: 2696 - RNA, 21 nt, Artificial Sequence
  Synthetic oligonucleotide
gugaauuacaucuucuuuaaa

SEQ ID NO: 2697 - RNA, 21 nt, Artificial Sequence
  Synthetic oligonucleotide
ugaauuacaucuucuuuaaag

SEQ ID NO: 2698 - RNA, 21 nt, Artificial Sequence
  Synthetic oligonucleotide
gaauuacaucuucuuuaaagg

SEQ ID NO: 2699 - RNA, 21 nt, Artificial Sequence
  Synthetic oligonucleotide
aauuacaucuucuuuaaaggc

SEQ ID NO: 2700 - RNA, 21 nt, Artificial Sequence
  Synthetic oligonucleotide
auuacaucuucuuuaaaggca

SEQ ID NO: 2701 - RNA, 21 nt, Artificial Sequence
  Synthetic oligonucleotide
uuacaucuucuuuaaaggcaa

SEQ ID NO: 2702 - RNA, 21 nt, Artificial Sequence
  Synthetic oligonucleotide
uacaucuucuuuaaaggcaaa

SEQ ID NO: 2703 - RNA, 21 nt, Artificial Sequence
  Synthetic oligonucleotide
ucuucuuuaaaggcaaauggg

SEQ ID NO: 2704 - RNA, 21 nt, Artificial Sequence
  Synthetic oligonucleotide
uucuuuaaaggcaaaugggag

SEQ ID NO: 2705 - RNA, 21 nt, Artificial Sequence
  Synthetic oligonucleotide
aggcaaaugggagagacccuu

SEQ ID NO: 2706 - RNA, 21 nt, Artificial Sequence
  Synthetic oligonucleotide
ggcaaaugggagagacccuuu

SEQ ID NO: 2707 - RNA, 21 nt, Artificial Sequence
  Synthetic oligonucleotide
gcaaaugggagagacccuuug

SEQ ID NO: 2708 - RNA, 21 nt, Artificial Sequence
  Synthetic oligonucleotide
caaaugggagagacccuuuga

SEQ ID NO: 2709 - RNA, 21 nt, Artificial Sequence
  Synthetic oligonucleotide
gcuguccagcugggugcugcu

SEQ ID NO: 2710 - RNA, 21 nt, Artificial Sequence
  Synthetic oligonucleotide
cuguccagcugggugcugcug

SEQ ID NO: 2711 - RNA, 21 nt, Artificial Sequence
  Synthetic oligonucleotide
uguccagcugggugcugcuga

SEQ ID NO: 2712 - RNA, 21 nt, Artificial Sequence
  Synthetic oligonucleotide
guccagcugggugcugcugau

SEQ ID NO: 2713 - RNA, 21 nt, Artificial Sequence
  Synthetic oligonucleotide
uccagcugggugcugcugaug

SEQ ID NO: 2714 - RNA, 21 nt, Artificial Sequence
  Synthetic oligonucleotide
ccagcugggugcugcugauga

SEQ ID NO: 2715 - RNA, 21 nt, Artificial Sequence
  Synthetic oligonucleotide
cagcugggugcugcugaugaa

SEQ ID NO: 2716 - RNA, 21 nt, Artificial Sequence
  Synthetic oligonucleotide
agcugggugcugcugaugaaa

SEQ ID NO: 2717 - RNA, 21 nt, Artificial Sequence
  Synthetic oligonucleotide
gcugggugcugcugaugaaau

SEQ ID NO: 2718 - RNA, 21 nt, Artificial Sequence
  Synthetic oligonucleotide
cugggugcugcugaugaaaua

SEQ ID NO: 2719 - RNA, 21 nt, Artificial Sequence
  Synthetic oligonucleotide
gggugcugcugaugaaauacc

SEQ ID NO: 2720 - RNA, 21 nt, Artificial Sequence
  Synthetic oligonucleotide
ggugcugcugaugaaauaccu

SEQ ID NO: 2721 - RNA, 21 nt, Artificial Sequence
  Synthetic oligonucleotide
gugcugcugaugaaauaccug

SEQ ID NO: 2722 - RNA, 21 nt, Artificial Sequence
  Synthetic oligonucleotide
ugcugcugaugaaauaccugg

SEQ ID NO: 2723 - RNA, 21 nt, Artificial Sequence
  Synthetic oligonucleotide
gcugcugaugaaauaccuggg

SEQ ID NO: 2724 - RNA, 21 nt, Artificial Sequence
  Synthetic oligonucleotide
cugcugaugaaauaccugggc

SEQ ID NO: 2725 - RNA, 21 nt, Artificial Sequence
  Synthetic oligonucleotide
ugcugaugaaauaccugggca

SEQ ID NO: 2726 - RNA, 21 nt, Artificial Sequence
  Synthetic oligonucleotide
gcugaugaaauaccugggcaa

SEQ ID NO: 2727 - RNA, 21 nt, Artificial Sequence
  Synthetic oligonucleotide
cugaugaaauaccugggcaau

SEQ ID NO: 2728 - RNA, 21 nt, Artificial Sequence
  Synthetic oligonucleotide
ugaugaaauaccugggcaaug

SEQ ID NO: 2729 - RNA, 21 nt, Artificial Sequence
  Synthetic oligonucleotide
augaaauaccugggcaaugcc

SEQ ID NO: 2730 - RNA, 21 nt, Artificial Sequence
  Synthetic oligonucleotide
uacagcaccuggaaaaugaac

SEQ ID NO: 2731 - RNA, 21 nt, Artificial Sequence
  Synthetic oligonucleotide
accuggaaaaugaacucaccc

SEQ ID NO: 2732 - RNA, 21 nt, Artificial Sequence
  Synthetic oligonucleotide
ccuggaaaaugaacucaccca

SEQ ID NO: 2733 - RNA, 21 nt, Artificial Sequence
  Synthetic oligonucleotide
acgauaucaucaccaaguucc

SEQ ID NO: 2734 - RNA, 21 nt, Artificial Sequence
  Synthetic oligonucleotide
accaaguuccuggaaaaugaa

SEQ ID NO: 2735 - RNA, 21 nt, Artificial Sequence
  Synthetic oligonucleotide
guccauuacuggaaccuauga

SEQ ID NO: 2736 - RNA, 21 nt, Artificial Sequence
  Synthetic oligonucleotide
uccauuacuggaaccuaugau

SEQ ID NO: 2737 - RNA, 21 nt, Artificial Sequence
  Synthetic oligonucleotide
ccauuacuggaaccuaugauc

SEQ ID NO: 2738 - RNA, 21 nt, Artificial Sequence
  Synthetic oligonucleotide
cauuacuggaaccuaugaucu

SEQ ID NO: 2739 - RNA, 21 nt, Artificial Sequence
  Synthetic oligonucleotide
auuacuggaaccuaugaucug

SEQ ID NO: 2740 - RNA, 21 nt, Artificial Sequence
  Synthetic oligonucleotide
uuacuggaaccuaugaucuga

SEQ ID NO: 2741 - RNA, 21 nt, Artificial Sequence
  Synthetic oligonucleotide
uacuggaaccuaugaucugaa

SEQ ID NO: 2742 - RNA, 21 nt, Artificial Sequence
  Synthetic oligonucleotide
acuggaaccuaugaucugaag

SEQ ID NO: 2743 - RNA, 21 nt, Artificial Sequence
  Synthetic oligonucleotide
cuggaaccuaugaucugaaga

SEQ ID NO: 2744 - RNA, 21 nt, Artificial Sequence
  Synthetic oligonucleotide
gcaucacuaaggucuucagca

SEQ ID NO: 2745 - RNA, 21 nt, Artificial Sequence
  Synthetic oligonucleotide
caucacuaaggucuucagcaa

SEQ ID NO: 2746 - RNA, 21 nt, Artificial Sequence
  Synthetic oligonucleotide
aucacuaaggucuucagcaau

SEQ ID NO: 2747 - RNA, 21 nt, Artificial Sequence
  Synthetic oligonucleotide
cacuaaggucuucagcaaugg

SEQ ID NO: 2748 - RNA, 21 nt, Artificial Sequence
  Synthetic oligonucleotide
acuaaggucuucagcaauggg

SEQ ID NO: 2749 - RNA, 21 nt, Artificial Sequence
  Synthetic oligonucleotide
ccugaagcucuccaaggccgu

SEQ ID NO: 2750 - RNA, 21 nt, Artificial Sequence
  Synthetic oligonucleotide
cugaagcucuccaaggccgug

SEQ ID NO: 2751 - RNA, 21 nt, Artificial Sequence
  Synthetic oligonucleotide
ugaagcucuccaaggccgugc

SEQ ID NO: 2752 - RNA, 21 nt, Artificial Sequence
  Synthetic oligonucleotide
ccccgaggucaaguucaacaa

SEQ ID NO: 2753 - RNA, 21 nt, Artificial Sequence
  Synthetic oligonucleotide
cccgaggucaaguucaacaaa

SEQ ID NO: 2754 - RNA, 21 nt, Artificial Sequence
  Synthetic oligonucleotide
ccgaggucaaguucaacaaac

SEQ ID NO: 2755 - RNA, 21 nt, Artificial Sequence
  Synthetic oligonucleotide
cgaggucaaguucaacaaacc

SEQ ID NO: 2756 - RNA, 21 nt, Artificial Sequence
  Synthetic oligonucleotide
gaggucaaguucaacaaaccc

SEQ ID NO: 2757 - RNA, 21 nt, Artificial Sequence
  Synthetic oligonucleotide
aggucaaguucaacaaacccu

SEQ ID NO: 2758 - RNA, 21 nt, Artificial Sequence
  Synthetic oligonucleotide
ggucaaguucaacaaacccuu

SEQ ID NO: 2759 - RNA, 21 nt, Artificial Sequence
  Synthetic oligonucleotide
gucaaguucaacaaacccuuu

SEQ ID NO: 2760 - RNA, 21 nt, Artificial Sequence
  Synthetic oligonucleotide
ucaaguucaacaaacccuuug

SEQ ID NO: 2761 - RNA, 21 nt, Artificial Sequence
  Synthetic oligonucleotide
caaguucaacaaacccuuugu

SEQ ID NO: 2762 - RNA, 27 nt, Artificial Sequence
  Synthetic oligonucleotide
ccccagggagaugcugcccagaagaca

SEQ ID NO: 2763 - RNA, 27 nt, Artificial Sequence
  Synthetic oligonucleotide
cccagggagaugcugcccagaagacag

SEQ ID NO: 2764 - RNA, 27 nt, Artificial Sequence
  Synthetic oligonucleotide
ccagggagaugcugcccagaagacaga

SEQ ID NO: 2765 - RNA, 27 nt, Artificial Sequence
  Synthetic oligonucleotide
cagggagaugcugcccagaagacagau

SEQ ID NO: 2766 - RNA, 27 nt, Artificial Sequence
  Synthetic oligonucleotide
agggagaugcugcccagaagacagaua

SEQ ID NO: 2767 - RNA, 27 nt, Artificial Sequence
  Synthetic oligonucleotide
gggagaugcugcccagaagacagauac

SEQ ID NO: 2768 - RNA, 27 nt, Artificial Sequence
  Synthetic oligonucleotide
cagauacaucccaccaugaucaggauc

SEQ ID NO: 2769 - RNA, 27 nt, Artificial Sequence
  Synthetic oligonucleotide
agauacaucccaccaugaucaggauca

SEQ ID NO: 2770 - RNA, 27 nt, Artificial Sequence
  Synthetic oligonucleotide
gauacaucccaccaugaucaggaucac

SEQ ID NO: 2771 - RNA, 27 nt, Artificial Sequence
  Synthetic oligonucleotide
auacaucccaccaugaucaggaucacc

SEQ ID NO: 2772 - RNA, 27 nt, Artificial Sequence
  Synthetic oligonucleotide
acaccaguccaacagcaccaauaucuu

SEQ ID NO: 2773 - RNA, 27 nt, Artificial Sequence
  Synthetic oligonucleotide
caccaguccaacagcaccaauaucuuc

SEQ ID NO: 2774 - RNA, 27 nt, Artificial Sequence
  Synthetic oligonucleotide
accaguccaacagcaccaauaucuucu

SEQ ID NO: 2775 - RNA, 27 nt, Artificial Sequence
  Synthetic oligonucleotide
ccaguccaacagcaccaauaucuucuu

SEQ ID NO: 2776 - RNA, 27 nt, Artificial Sequence
  Synthetic oligonucleotide
caguccaacagcaccaauaucuucuuc

SEQ ID NO: 2777 - RNA, 27 nt, Artificial Sequence
  Synthetic oligonucleotide
aguccaacagcaccaauaucuucuucu

SEQ ID NO: 2778 - RNA, 27 nt, Artificial Sequence
  Synthetic oligonucleotide
guccaacagcaccaauaucuucuucuc

SEQ ID NO: 2779 - RNA, 27 nt, Artificial Sequence
  Synthetic oligonucleotide
uccaacagcaccaauaucuucuucucc

SEQ ID NO: 2780 - RNA, 27 nt, Artificial Sequence
  Synthetic oligonucleotide
ccaacagcaccaauaucuucuucuccc

SEQ ID NO: 2781 - RNA, 27 nt, Artificial Sequence
  Synthetic oligonucleotide
caacagcaccaauaucuucuucucccc

SEQ ID NO: 2782 - RNA, 27 nt, Artificial Sequence
  Synthetic oligonucleotide
aacagcaccaauaucuucuucucccca

SEQ ID NO: 2783 - RNA, 27 nt, Artificial Sequence
  Synthetic oligonucleotide
acagcaccaauaucuucuucuccccag

SEQ ID NO: 2784 - RNA, 27 nt, Artificial Sequence
  Synthetic oligonucleotide
cagcaccaauaucuucuucuccccagu

SEQ ID NO: 2785 - RNA, 27 nt, Artificial Sequence
  Synthetic oligonucleotide
agcaccaauaucuucuucuccccagug

SEQ ID NO: 2786 - RNA, 27 nt, Artificial Sequence
  Synthetic oligonucleotide
gcaccaauaucuucuucuccccaguga

SEQ ID NO: 2787 - RNA, 27 nt, Artificial Sequence
  Synthetic oligonucleotide
uccccagugagcaucgcuacagccuuu

SEQ ID NO: 2788 - RNA, 27 nt, Artificial Sequence
  Synthetic oligonucleotide
ccccagugagcaucgcuacagccuuug

SEQ ID NO: 2789 - RNA, 27 nt, Artificial Sequence
  Synthetic oligonucleotide
cccagugagcaucgcuacagccuuugc

SEQ ID NO: 2790 - RNA, 27 nt, Artificial Sequence
  Synthetic oligonucleotide
ccagugagcaucgcuacagccuuugca

SEQ ID NO: 2791 - RNA, 27 nt, Artificial Sequence
  Synthetic oligonucleotide
cagugagcaucgcuacagccuuugcaa

SEQ ID NO: 2792 - RNA, 27 nt, Artificial Sequence
  Synthetic oligonucleotide
agugagcaucgcuacagccuuugcaau

SEQ ID NO: 2793 - RNA, 27 nt, Artificial Sequence
  Synthetic oligonucleotide
gugagcaucgcuacagccuuugcaaug

SEQ ID NO: 2794 - RNA, 27 nt, Artificial Sequence
  Synthetic oligonucleotide
ugagcaucgcuacagccuuugcaaugc

SEQ ID NO: 2795 - RNA, 27 nt, Artificial Sequence
  Synthetic oligonucleotide
gagcaucgcuacagccuuugcaaugcu

SEQ ID NO: 2796 - RNA, 27 nt, Artificial Sequence
  Synthetic oligonucleotide
agcaucgcuacagccuuugcaaugcuc

SEQ ID NO: 2797 - RNA, 27 nt, Artificial Sequence
  Synthetic oligonucleotide
gcaucgcuacagccuuugcaaugcucu

SEQ ID NO: 2798 - RNA, 27 nt, Artificial Sequence
  Synthetic oligonucleotide
caucgcuacagccuuugcaaugcucuc

SEQ ID NO: 2799 - RNA, 27 nt, Artificial Sequence
  Synthetic oligonucleotide
aucgcuacagccuuugcaaugcucucc

SEQ ID NO: 2800 - RNA, 27 nt, Artificial Sequence
  Synthetic oligonucleotide
ucgcuacagccuuugcaaugcucuccc

SEQ ID NO: 2801 - RNA, 27 nt, Artificial Sequence
  Synthetic oligonucleotide
cgcuacagccuuugcaaugcucucccu

SEQ ID NO: 2802 - RNA, 27 nt, Artificial Sequence
  Synthetic oligonucleotide
gcuacagccuuugcaaugcucucccug

SEQ ID NO: 2803 - RNA, 27 nt, Artificial Sequence
  Synthetic oligonucleotide
ucccuggggaccaaggcugacacucac

SEQ ID NO: 2804 - RNA, 27 nt, Artificial Sequence
  Synthetic oligonucleotide
uggggaccaaggcugacacucacgaug

SEQ ID NO: 2805 - RNA, 27 nt, Artificial Sequence
  Synthetic oligonucleotide
ggggaccaaggcugacacucacgauga

SEQ ID NO: 2806 - RNA, 27 nt, Artificial Sequence
  Synthetic oligonucleotide
gggaccaaggcugacacucacgaugaa

SEQ ID NO: 2807 - RNA, 27 nt, Artificial Sequence
  Synthetic oligonucleotide
gaugaaauccuggagggccugaauuuc

SEQ ID NO: 2808 - RNA, 27 nt, Artificial Sequence
  Synthetic oligonucleotide
augaaauccuggagggccugaauuuca

SEQ ID NO: 2809 - RNA, 27 nt, Artificial Sequence
  Synthetic oligonucleotide
gauccaugaaggcuuccaggaacuccu

SEQ ID NO: 2810 - RNA, 27 nt, Artificial Sequence
  Synthetic oligonucleotide
auccaugaaggcuuccaggaacuccuc

SEQ ID NO: 2811 - RNA, 27 nt, Artificial Sequence
  Synthetic oligonucleotide
ggggacaccgaagaggccaagaaacag

SEQ ID NO: 2812 - RNA, 27 nt, Artificial Sequence
  Synthetic oligonucleotide
gggacaccgaagaggccaagaaacaga

SEQ ID NO: 2813 - RNA, 27 nt, Artificial Sequence
  Synthetic oligonucleotide
ggacaccgaagaggccaagaaacagau

SEQ ID NO: 2814 - RNA, 27 nt, Artificial Sequence
  Synthetic oligonucleotide
gacaccgaagaggccaagaaacagauc

SEQ ID NO: 2815 - RNA, 27 nt, Artificial Sequence
  Synthetic oligonucleotide
acaccgaagaggccaagaaacagauca

SEQ ID NO: 2816 - RNA, 27 nt, Artificial Sequence
  Synthetic oligonucleotide
caccgaagaggccaagaaacagaucaa

SEQ ID NO: 2817 - RNA, 27 nt, Artificial Sequence
  Synthetic oligonucleotide
accgaagaggccaagaaacagaucaac

SEQ ID NO: 2818 - RNA, 27 nt, Artificial Sequence
  Synthetic oligonucleotide
ccgaagaggccaagaaacagaucaacg

SEQ ID NO: 2819 - RNA, 27 nt, Artificial Sequence
  Synthetic oligonucleotide
cgaagaggccaagaaacagaucaacga

SEQ ID NO: 2820 - RNA, 27 nt, Artificial Sequence
  Synthetic oligonucleotide
gaagaggccaagaaacagaucaacgau

SEQ ID NO: 2821 - RNA, 27 nt, Artificial Sequence
  Synthetic oligonucleotide
aagaggccaagaaacagaucaacgauu

SEQ ID NO: 2822 - RNA, 27 nt, Artificial Sequence
  Synthetic oligonucleotide
agaggccaagaaacagaucaacgauua

SEQ ID NO: 2823 - RNA, 27 nt, Artificial Sequence
  Synthetic oligonucleotide
gaggccaagaaacagaucaacgauuac

SEQ ID NO: 2824 - RNA, 27 nt, Artificial Sequence
  Synthetic oligonucleotide
guuuuugcucuggugaauuacaucuuc

SEQ ID NO: 2825 - RNA, 27 nt, Artificial Sequence
  Synthetic oligonucleotide
uuuuugcucuggugaauuacaucuucu

SEQ ID NO: 2826 - RNA, 27 nt, Artificial Sequence
  Synthetic oligonucleotide
uuuugcucuggugaauuacaucuucuu

SEQ ID NO: 2827 - RNA, 27 nt, Artificial Sequence
  Synthetic oligonucleotide
uuugcucuggugaauuacaucuucuuu

SEQ ID NO: 2828 - RNA, 27 nt, Artificial Sequence
  Synthetic oligonucleotide
uugcucuggugaauuacaucuucuuua

SEQ ID NO: 2829 - RNA, 27 nt, Artificial Sequence
  Synthetic oligonucleotide
ugcucuggugaauuacaucuucuuuaa

SEQ ID NO: 2830 - RNA, 27 nt, Artificial Sequence
  Synthetic oligonucleotide
gcucuggugaauuacaucuucuuuaaa

SEQ ID NO: 2831 - RNA, 27 nt, Artificial Sequence
  Synthetic oligonucleotide
cucuggugaauuacaucuucuuuaaag

SEQ ID NO: 2832 - RNA, 27 nt, Artificial Sequence
  Synthetic oligonucleotide
ucuggugaauuacaucuucuuuaaagg

SEQ ID NO: 2833 - RNA, 27 nt, Artificial Sequence
  Synthetic oligonucleotide
cuggugaauuacaucuucuuuaaaggc

SEQ ID NO: 2834 - RNA, 27 nt, Artificial Sequence
  Synthetic oligonucleotide
uggugaauuacaucuucuuuaaaggca

SEQ ID NO: 2835 - RNA, 27 nt, Artificial Sequence
  Synthetic oligonucleotide
ggugaauuacaucuucuuuaaaggcaa

SEQ ID NO: 2836 - RNA, 27 nt, Artificial Sequence
  Synthetic oligonucleotide
gugaauuacaucuucuuuaaaggcaaa

SEQ ID NO: 2837 - RNA, 27 nt, Artificial Sequence
  Synthetic oligonucleotide
ugaauuacaucuucuuuaaaggcaaau

SEQ ID NO: 2838 - RNA, 27 nt, Artificial Sequence
  Synthetic oligonucleotide
gaauuacaucuucuuuaaaggcaaaug

SEQ ID NO: 2839 - RNA, 27 nt, Artificial Sequence
  Synthetic oligonucleotide
aauuacaucuucuuuaaaggcaaaugg

SEQ ID NO: 2840 - RNA, 27 nt, Artificial Sequence
  Synthetic oligonucleotide
auuacaucuucuuuaaaggcaaauggg

SEQ ID NO: 2841 - RNA, 27 nt, Artificial Sequence
  Synthetic oligonucleotide
uuacaucuucuuuaaaggcaaauggga

SEQ ID NO: 2842 - RNA, 27 nt, Artificial Sequence
  Synthetic oligonucleotide
uacaucuucuuuaaaggcaaaugggag

SEQ ID NO: 2843 - RNA, 27 nt, Artificial Sequence
  Synthetic oligonucleotide
ucuucuuuaaaggcaaaugggagagac

SEQ ID NO: 2844 - RNA, 27 nt, Artificial Sequence
  Synthetic oligonucleotide
uucuuuaaaggcaaaugggagagaccc

SEQ ID NO: 2845 - RNA, 27 nt, Artificial Sequence
  Synthetic oligonucleotide
aggcaaaugggagagacccuuugaagu

SEQ ID NO: 2846 - RNA, 27 nt, Artificial Sequence
  Synthetic oligonucleotide
ggcaaaugggagagacccuuugaaguc

SEQ ID NO: 2847 - RNA, 27 nt, Artificial Sequence
  Synthetic oligonucleotide
gcaaaugggagagacccuuugaaguca

SEQ ID NO: 2848 - RNA, 27 nt, Artificial Sequence
  Synthetic oligonucleotide
caaaugggagagacccuuugaagucaa

SEQ ID NO: 2849 - RNA, 27 nt, Artificial Sequence
  Synthetic oligonucleotide
gcuguccagcugggugcugcugaugaa

SEQ ID NO: 2850 - RNA, 27 nt, Artificial Sequence
  Synthetic oligonucleotide
cuguccagcugggugcugcugaugaaa

SEQ ID NO: 2851 - RNA, 27 nt, Artificial Sequence
  Synthetic oligonucleotide
uguccagcugggugcugcugaugaaau

SEQ ID NO: 2852 - RNA, 27 nt, Artificial Sequence
  Synthetic oligonucleotide
guccagcugggugcugcugaugaaaua

SEQ ID NO: 2853 - RNA, 27 nt, Artificial Sequence
  Synthetic oligonucleotide
uccagcugggugcugcugaugaaauac

SEQ ID NO: 2854 - RNA, 27 nt, Artificial Sequence
  Synthetic oligonucleotide
ccagcugggugcugcugaugaaauacc

SEQ ID NO: 2855 - RNA, 27 nt, Artificial Sequence
  Synthetic oligonucleotide
cagcugggugcugcugaugaaauaccu

SEQ ID NO: 2856 - RNA, 27 nt, Artificial Sequence
  Synthetic oligonucleotide
agcugggugcugcugaugaaauaccug

SEQ ID NO: 2857 - RNA, 27 nt, Artificial Sequence
  Synthetic oligonucleotide
gcugggugcugcugaugaaauaccugg

SEQ ID NO: 2858 - RNA, 27 nt, Artificial Sequence
  Synthetic oligonucleotide
cugggugcugcugaugaaauaccuggg

SEQ ID NO: 2859 - RNA, 27 nt, Artificial Sequence
  Synthetic oligonucleotide
gggugcugcugaugaaauaccugggca

SEQ ID NO: 2860 - RNA, 27 nt, Artificial Sequence
  Synthetic oligonucleotide
ggugcugcugaugaaauaccugggcaa

SEQ ID NO: 2861 - RNA, 27 nt, Artificial Sequence
  Synthetic oligonucleotide
gugcugcugaugaaauaccugggcaau

SEQ ID NO: 2862 - RNA, 27 nt, Artificial Sequence
  Synthetic oligonucleotide
ugcugcugaugaaauaccugggcaaug

SEQ ID NO: 2863 - RNA, 27 nt, Artificial Sequence
  Synthetic oligonucleotide
gcugcugaugaaauaccugggcaaugc

SEQ ID NO: 2864 - RNA, 27 nt, Artificial Sequence
  Synthetic oligonucleotide
cugcugaugaaauaccugggcaaugcc

SEQ ID NO: 2865 - RNA, 27 nt, Artificial Sequence
  Synthetic oligonucleotide
ugcugaugaaauaccugggcaaugcca

SEQ ID NO: 2866 - RNA, 27 nt, Artificial Sequence
  Synthetic oligonucleotide
gcugaugaaauaccugggcaaugccac

SEQ ID NO: 2867 - RNA, 27 nt, Artificial Sequence
  Synthetic oligonucleotide
cugaugaaauaccugggcaaugccacc

SEQ ID NO: 2868 - RNA, 27 nt, Artificial Sequence
  Synthetic oligonucleotide
ugaugaaauaccugggcaaugccaccg

SEQ ID NO: 2869 - RNA, 27 nt, Artificial Sequence
  Synthetic oligonucleotide
augaaauaccugggcaaugccaccgcc

SEQ ID NO: 2870 - RNA, 27 nt, Artificial Sequence
  Synthetic oligonucleotide
uacagcaccuggaaaaugaacucaccc

SEQ ID NO: 2871 - RNA, 27 nt, Artificial Sequence
  Synthetic oligonucleotide
accuggaaaaugaacucacccacgaua

SEQ ID NO: 2872 - RNA, 27 nt, Artificial Sequence
  Synthetic oligonucleotide
ccuggaaaaugaacucacccacgauau

SEQ ID NO: 2873 - RNA, 27 nt, Artificial Sequence
  Synthetic oligonucleotide
acgauaucaucaccaaguuccuggaaa

SEQ ID NO: 2874 - RNA, 27 nt, Artificial Sequence
  Synthetic oligonucleotide
accaaguuccuggaaaaugaagacaga

SEQ ID NO: 2875 - RNA, 27 nt, Artificial Sequence
  Synthetic oligonucleotide
guccauuacuggaaccuaugaucugaa

SEQ ID NO: 2876 - RNA, 27 nt, Artificial Sequence
  Synthetic oligonucleotide
uccauuacuggaaccuaugaucugaag

SEQ ID NO: 2877 - RNA, 27 nt, Artificial Sequence
  Synthetic oligonucleotide
ccauuacuggaaccuaugaucugaaga

SEQ ID NO: 2878 - RNA, 27 nt, Artificial Sequence
  Synthetic oligonucleotide
cauuacuggaaccuaugaucugaagag

SEQ ID NO: 2879 - RNA, 27 nt, Artificial Sequence
  Synthetic oligonucleotide
auuacuggaaccuaugaucugaagagc

SEQ ID NO: 2880 - RNA, 27 nt, Artificial Sequence
  Synthetic oligonucleotide
uuacuggaaccuaugaucugaagagcg

SEQ ID NO: 2881 - RNA, 27 nt, Artificial Sequence
  Synthetic oligonucleotide
uacuggaaccuaugaucugaagagcgu

SEQ ID NO: 2882 - RNA, 27 nt, Artificial Sequence
  Synthetic oligonucleotide
acuggaaccuaugaucugaagagcguc

SEQ ID NO: 2883 - RNA, 27 nt, Artificial Sequence
  Synthetic oligonucleotide
cuggaaccuaugaucugaagagcgucc

SEQ ID NO: 2884 - RNA, 27 nt, Artificial Sequence
  Synthetic oligonucleotide
gcaucacuaaggucuucagcaaugggg

SEQ ID NO: 2885 - RNA, 27 nt, Artificial Sequence
  Synthetic oligonucleotide
caucacuaaggucuucagcaauggggc

SEQ ID NO: 2886 - RNA, 27 nt, Artificial Sequence
  Synthetic oligonucleotide
aucacuaaggucuucagcaauggggcu

SEQ ID NO: 2887 - RNA, 27 nt, Artificial Sequence
  Synthetic oligonucleotide
cacuaaggucuucagcaauggggcuga

SEQ ID NO: 2888 - RNA, 27 nt, Artificial Sequence
  Synthetic oligonucleotide
acuaaggucuucagcaauggggcugac

SEQ ID NO: 2889 - RNA, 27 nt, Artificial Sequence
  Synthetic oligonucleotide
ccugaagcucuccaaggccgugcauaa

SEQ ID NO: 2890 - RNA, 27 nt, Artificial Sequence
  Synthetic oligonucleotide
cugaagcucuccaaggccgugcauaag

SEQ ID NO: 2891 - RNA, 27 nt, Artificial Sequence
  Synthetic oligonucleotide
ugaagcucuccaaggccgugcauaagg

SEQ ID NO: 2892 - RNA, 27 nt, Artificial Sequence
  Synthetic oligonucleotide
ccccgaggucaaguucaacaaacccuu

SEQ ID NO: 2893 - RNA, 27 nt, Artificial Sequence
  Synthetic oligonucleotide
cccgaggucaaguucaacaaacccuuu

SEQ ID NO: 2894 - RNA, 27 nt, Artificial Sequence
  Synthetic oligonucleotide
ccgaggucaaguucaacaaacccuuug

SEQ ID NO: 2895 - RNA, 27 nt, Artificial Sequence
  Synthetic oligonucleotide
cgaggucaaguucaacaaacccuuugu

SEQ ID NO: 2896 - RNA, 27 nt, Artificial Sequence
  Synthetic oligonucleotide
gaggucaaguucaacaaacccuuuguc

SEQ ID NO: 2897 - RNA, 27 nt, Artificial Sequence
  Synthetic oligonucleotide
aggucaaguucaacaaacccuuugucu

SEQ ID NO: 2898 - RNA, 27 nt, Artificial Sequence
  Synthetic oligonucleotide
ggucaaguucaacaaacccuuugucuu

SEQ ID NO: 2899 - RNA, 27 nt, Artificial Sequence
  Synthetic oligonucleotide
gucaaguucaacaaacccuuugucuuc

SEQ ID NO: 2900 - RNA, 27 nt, Artificial Sequence
  Synthetic oligonucleotide
ucaaguucaacaaacccuuugucuucu

SEQ ID NO: 2901 - RNA, 27 nt, Artificial Sequence
  Synthetic oligonucleotide
caaguucaacaaacccuuugucuucuu

SEQ ID NO: 2902 - RNA, 19 nt, Artificial Sequence
  Synthetic oligonucleotide
ccagggagaugcugcccag

SEQ ID NO: 2903 - RNA, 19 nt, Artificial Sequence
  Synthetic oligonucleotide
cagggagaugcugcccaga

SEQ ID NO: 2904 - RNA, 19 nt, Artificial Sequence
  Synthetic oligonucleotide
agggagaugcugcccagaa

SEQ ID NO: 2905 - RNA, 19 nt, Artificial Sequence
  Synthetic oligonucleotide
gggagaugcugcccagaag

SEQ ID NO: 2906 - RNA, 19 nt, Artificial Sequence
  Synthetic oligonucleotide
ggagaugcugcccagaaga

SEQ ID NO: 2907 - RNA, 19 nt, Artificial Sequence
  Synthetic oligonucleotide
gagaugcugcccagaagac

SEQ ID NO: 2908 - RNA, 19 nt, Artificial Sequence
  Synthetic oligonucleotide
gauacaucccaccaugauc

SEQ ID NO: 2909 - RNA, 19 nt, Artificial Sequence
  Synthetic oligonucleotide
auacaucccaccaugauca

SEQ ID NO: 2910 - RNA, 19 nt, Artificial Sequence
  Synthetic oligonucleotide
uacaucccaccaugaucag

SEQ ID NO: 2911 - RNA, 19 nt, Artificial Sequence
  Synthetic oligonucleotide
acaucccaccaugaucagg

SEQ ID NO: 2912 - RNA, 19 nt, Artificial Sequence
  Synthetic oligonucleotide
accaguccaacagcaccaa

SEQ ID NO: 2913 - RNA, 19 nt, Artificial Sequence
  Synthetic oligonucleotide
ccaguccaacagcaccaau

SEQ ID NO: 2914 - RNA, 19 nt, Artificial Sequence
  Synthetic oligonucleotide
caguccaacagcaccaaua

SEQ ID NO: 2915 - RNA, 19 nt, Artificial Sequence
  Synthetic oligonucleotide
aguccaacagcaccaauau

SEQ ID NO: 2916 - RNA, 19 nt, Artificial Sequence
  Synthetic oligonucleotide
guccaacagcaccaauauc

SEQ ID NO: 2917 - RNA, 19 nt, Artificial Sequence
  Synthetic oligonucleotide
uccaacagcaccaauaucu

SEQ ID NO: 2918 - RNA, 19 nt, Artificial Sequence
  Synthetic oligonucleotide
ccaacagcaccaauaucuu

SEQ ID NO: 2919 - RNA, 19 nt, Artificial Sequence
  Synthetic oligonucleotide
caacagcaccaauaucuuc

SEQ ID NO: 2920 - RNA, 19 nt, Artificial Sequence
  Synthetic oligonucleotide
aacagcaccaauaucuucu

SEQ ID NO: 2921 - RNA, 19 nt, Artificial Sequence
  Synthetic oligonucleotide
acagcaccaauaucuucuu

SEQ ID NO: 2922 - RNA, 19 nt, Artificial Sequence
  Synthetic oligonucleotide
cagcaccaauaucuucuuc

SEQ ID NO: 2923 - RNA, 19 nt, Artificial Sequence
  Synthetic oligonucleotide
agcaccaauaucuucuucu

SEQ ID NO: 2924 - RNA, 19 nt, Artificial Sequence
  Synthetic oligonucleotide
gcaccaauaucuucuucuc

SEQ ID NO: 2925 - RNA, 19 nt, Artificial Sequence
  Synthetic oligonucleotide
caccaauaucuucuucucc

SEQ ID NO: 2926 - RNA, 19 nt, Artificial Sequence
  Synthetic oligonucleotide
accaauaucuucuucuccc

SEQ ID NO: 2927 - RNA, 19 nt, Artificial Sequence
  Synthetic oligonucleotide
cccagugagcaucgcuaca

SEQ ID NO: 2928 - RNA, 19 nt, Artificial Sequence
  Synthetic oligonucleotide
ccagugagcaucgcuacag

SEQ ID NO: 2929 - RNA, 19 nt, Artificial Sequence
  Synthetic oligonucleotide
cagugagcaucgcuacagc

SEQ ID NO: 2930 - RNA, 19 nt, Artificial Sequence
  Synthetic oligonucleotide
agugagcaucgcuacagcc

SEQ ID NO: 2931 - RNA, 19 nt, Artificial Sequence
  Synthetic oligonucleotide
gugagcaucgcuacagccu

SEQ ID NO: 2932 - RNA, 19 nt, Artificial Sequence
  Synthetic oligonucleotide
ugagcaucgcuacagccuu

SEQ ID NO: 2933 - RNA, 19 nt, Artificial Sequence
  Synthetic oligonucleotide
gagcaucgcuacagccuuu

SEQ ID NO: 2934 - RNA, 19 nt, Artificial Sequence
  Synthetic oligonucleotide
agcaucgcuacagccuuug

SEQ ID NO: 2935 - RNA, 19 nt, Artificial Sequence
  Synthetic oligonucleotide
gcaucgcuacagccuuugc

SEQ ID NO: 2936 - RNA, 19 nt, Artificial Sequence
  Synthetic oligonucleotide
caucgcuacagccuuugca

SEQ ID NO: 2937 - RNA, 19 nt, Artificial Sequence
  Synthetic oligonucleotide
aucgcuacagccuuugcaa

SEQ ID NO: 2938 - RNA, 19 nt, Artificial Sequence
  Synthetic oligonucleotide
ucgcuacagccuuugcaau

SEQ ID NO: 2939 - RNA, 19 nt, Artificial Sequence
  Synthetic oligonucleotide
cgcuacagccuuugcaaug

SEQ ID NO: 2940 - RNA, 19 nt, Artificial Sequence
  Synthetic oligonucleotide
gcuacagccuuugcaaugc

SEQ ID NO: 2941 - RNA, 19 nt, Artificial Sequence
  Synthetic oligonucleotide
cuacagccuuugcaaugcu

SEQ ID NO: 2942 - RNA, 19 nt, Artificial Sequence
  Synthetic oligonucleotide
uacagccuuugcaaugcuc

SEQ ID NO: 2943 - RNA, 19 nt, Artificial Sequence
  Synthetic oligonucleotide
ccuggggaccaaggcugac

SEQ ID NO: 2944 - RNA, 19 nt, Artificial Sequence
  Synthetic oligonucleotide
gggaccaaggcugacacuc

SEQ ID NO: 2945 - RNA, 19 nt, Artificial Sequence
  Synthetic oligonucleotide
ggaccaaggcugacacuca

SEQ ID NO: 2946 - RNA, 19 nt, Artificial Sequence
  Synthetic oligonucleotide
gaccaaggcugacacucac

SEQ ID NO: 2947 - RNA, 19 nt, Artificial Sequence
  Synthetic oligonucleotide
ugaaauccuggagggccug

SEQ ID NO: 2948 - RNA, 19 nt, Artificial Sequence
  Synthetic oligonucleotide
gaaauccuggagggccuga

SEQ ID NO: 2949 - RNA, 19 nt, Artificial Sequence
  Synthetic oligonucleotide
uccaugaaggcuuccagga

SEQ ID NO: 2950 - RNA, 19 nt, Artificial Sequence
  Synthetic oligonucleotide
ccaugaaggcuuccaggaa

SEQ ID NO: 2951 - RNA, 19 nt, Artificial Sequence
  Synthetic oligonucleotide
ggacaccgaagaggccaag

SEQ ID NO: 2952 - RNA, 19 nt, Artificial Sequence
  Synthetic oligonucleotide
gacaccgaagaggccaaga

SEQ ID NO: 2953 - RNA, 19 nt, Artificial Sequence
  Synthetic oligonucleotide
acaccgaagaggccaagaa

SEQ ID NO: 2954 - RNA, 19 nt, Artificial Sequence
  Synthetic oligonucleotide
caccgaagaggccaagaaa

SEQ ID NO: 2955 - RNA, 19 nt, Artificial Sequence
  Synthetic oligonucleotide
accgaagaggccaagaaac

SEQ ID NO: 2956 - RNA, 19 nt, Artificial Sequence
  Synthetic oligonucleotide
ccgaagaggccaagaaaca

SEQ ID NO: 2957 - RNA, 19 nt, Artificial Sequence
  Synthetic oligonucleotide
cgaagaggccaagaaacag

SEQ ID NO: 2958 - RNA, 19 nt, Artificial Sequence
  Synthetic oligonucleotide
gaagaggccaagaaacaga

SEQ ID NO: 2959 - RNA, 19 nt, Artificial Sequence
  Synthetic oligonucleotide
aagaggccaagaaacagau

SEQ ID NO: 2960 - RNA, 19 nt, Artificial Sequence
  Synthetic oligonucleotide
agaggccaagaaacagauc

SEQ ID NO: 2961 - RNA, 19 nt, Artificial Sequence
  Synthetic oligonucleotide
gaggccaagaaacagauca

SEQ ID NO: 2962 - RNA, 19 nt, Artificial Sequence
  Synthetic oligonucleotide
aggccaagaaacagaucaa

SEQ ID NO: 2963 - RNA, 19 nt, Artificial Sequence
  Synthetic oligonucleotide
ggccaagaaacagaucaac

SEQ ID NO: 2964 - RNA, 19 nt, Artificial Sequence
  Synthetic oligonucleotide
uuuugcucuggugaauuac

SEQ ID NO: 2965 - RNA, 19 nt, Artificial Sequence
  Synthetic oligonucleotide
uuugcucuggugaauuaca

SEQ ID NO: 2966 - RNA, 19 nt, Artificial Sequence
  Synthetic oligonucleotide
uugcucuggugaauuacau

SEQ ID NO: 2967 - RNA, 19 nt, Artificial Sequence
  Synthetic oligonucleotide
ugcucuggugaauuacauc

SEQ ID NO: 2968 - RNA, 19 nt, Artificial Sequence
  Synthetic oligonucleotide
gcucuggugaauuacaucu

SEQ ID NO: 2969 - RNA, 19 nt, Artificial Sequence
  Synthetic oligonucleotide
cucuggugaauuacaucuu

SEQ ID NO: 2970 - RNA, 19 nt, Artificial Sequence
  Synthetic oligonucleotide
ucuggugaauuacaucuuc

SEQ ID NO: 2971 - RNA, 19 nt, Artificial Sequence
  Synthetic oligonucleotide
cuggugaauuacaucuucu

SEQ ID NO: 2972 - RNA, 19 nt, Artificial Sequence
  Synthetic oligonucleotide
uggugaauuacaucuucuu

SEQ ID NO: 2973 - RNA, 19 nt, Artificial Sequence
  Synthetic oligonucleotide
ggugaauuacaucuucuuu

SEQ ID NO: 2974 - RNA, 19 nt, Artificial Sequence
  Synthetic oligonucleotide
gugaauuacaucuucuuua

SEQ ID NO: 2975 - RNA, 19 nt, Artificial Sequence
  Synthetic oligonucleotide
ugaauuacaucuucuuuaa

SEQ ID NO: 2976 - RNA, 19 nt, Artificial Sequence
  Synthetic oligonucleotide
gaauuacaucuucuuuaaa

SEQ ID NO: 2977 - RNA, 19 nt, Artificial Sequence
  Synthetic oligonucleotide
aauuacaucuucuuuaaag

SEQ ID NO: 2978 - RNA, 19 nt, Artificial Sequence
  Synthetic oligonucleotide
auuacaucuucuuuaaagg

SEQ ID NO: 2979 - RNA, 19 nt, Artificial Sequence
  Synthetic oligonucleotide
uuacaucuucuuuaaaggc

SEQ ID NO: 2980 - RNA, 19 nt, Artificial Sequence
  Synthetic oligonucleotide
uacaucuucuuuaaaggca

SEQ ID NO: 2981 - RNA, 19 nt, Artificial Sequence
  Synthetic oligonucleotide
acaucuucuuuaaaggcaa

SEQ ID NO: 2982 - RNA, 19 nt, Artificial Sequence
  Synthetic oligonucleotide
caucuucuuuaaaggcaaa

SEQ ID NO: 2983 - RNA, 19 nt, Artificial Sequence
  Synthetic oligonucleotide
uucuuuaaaggcaaauggg

SEQ ID NO: 2984 - RNA, 19 nt, Artificial Sequence
  Synthetic oligonucleotide
cuuuaaaggcaaaugggag

SEQ ID NO: 2985 - RNA, 19 nt, Artificial Sequence
  Synthetic oligonucleotide
gcaaaugggagagacccuu

SEQ ID NO: 2986 - RNA, 19 nt, Artificial Sequence
  Synthetic oligonucleotide
caaaugggagagacccuuu

SEQ ID NO: 2987 - RNA, 19 nt, Artificial Sequence
  Synthetic oligonucleotide
aaaugggagagacccuuug

SEQ ID NO: 2988 - RNA, 19 nt, Artificial Sequence
  Synthetic oligonucleotide
aaugggagagacccuuuga

SEQ ID NO: 2989 - RNA, 19 nt, Artificial Sequence
  Synthetic oligonucleotide
uguccagcugggugcugcu

SEQ ID NO: 2990 - RNA, 19 nt, Artificial Sequence
  Synthetic oligonucleotide
guccagcugggugcugcug

SEQ ID NO: 2991 - RNA, 19 nt, Artificial Sequence
  Synthetic oligonucleotide
uccagcugggugcugcuga

SEQ ID NO: 2992 - RNA, 19 nt, Artificial Sequence
  Synthetic oligonucleotide
ccagcugggugcugcugau

SEQ ID NO: 2993 - RNA, 19 nt, Artificial Sequence
  Synthetic oligonucleotide
cagcugggugcugcugaug

SEQ ID NO: 2994 - RNA, 19 nt, Artificial Sequence
  Synthetic oligonucleotide
agcugggugcugcugauga

SEQ ID NO: 2995 - RNA, 19 nt, Artificial Sequence
  Synthetic oligonucleotide
gcugggugcugcugaugaa

SEQ ID NO: 2996 - RNA, 19 nt, Artificial Sequence
  Synthetic oligonucleotide
cugggugcugcugaugaaa

SEQ ID NO: 2997 - RNA, 19 nt, Artificial Sequence
  Synthetic oligonucleotide
ugggugcugcugaugaaau

SEQ ID NO: 2998 - RNA, 19 nt, Artificial Sequence
  Synthetic oligonucleotide
gggugcugcugaugaaaua

SEQ ID NO: 2999 - RNA, 19 nt, Artificial Sequence
  Synthetic oligonucleotide
gugcugcugaugaaauacc

SEQ ID NO: 3000 - RNA, 19 nt, Artificial Sequence
  Synthetic oligonucleotide
ugcugcugaugaaauaccu

SEQ ID NO: 3001 - RNA, 19 nt, Artificial Sequence
  Synthetic oligonucleotide
gcugcugaugaaauaccug

SEQ ID NO: 3002 - RNA, 19 nt, Artificial Sequence
  Synthetic oligonucleotide
cugcugaugaaauaccugg

SEQ ID NO: 3003 - RNA, 19 nt, Artificial Sequence
  Synthetic oligonucleotide
ugcugaugaaauaccuggg

SEQ ID NO: 3004 - RNA, 19 nt, Artificial Sequence
  Synthetic oligonucleotide
gcugaugaaauaccugggc

SEQ ID NO: 3005 - RNA, 19 nt, Artificial Sequence
  Synthetic oligonucleotide
cugaugaaauaccugggca

SEQ ID NO: 3006 - RNA, 19 nt, Artificial Sequence
  Synthetic oligonucleotide
ugaugaaauaccugggcaa

SEQ ID NO: 3007 - RNA, 19 nt, Artificial Sequence
  Synthetic oligonucleotide
gaugaaauaccugggcaau

SEQ ID NO: 3008 - RNA, 19 nt, Artificial Sequence
  Synthetic oligonucleotide
augaaauaccugggcaaug

SEQ ID NO: 3009 - RNA, 19 nt, Artificial Sequence
  Synthetic oligonucleotide
gaaauaccugggcaaugcc

SEQ ID NO: 3010 - RNA, 19 nt, Artificial Sequence
  Synthetic oligonucleotide
cagcaccuggaaaaugaac

SEQ ID NO: 3011 - RNA, 19 nt, Artificial Sequence
  Synthetic oligonucleotide
cuggaaaaugaacucaccc

SEQ ID NO: 3012 - RNA, 19 nt, Artificial Sequence
  Synthetic oligonucleotide
uggaaaaugaacucaccca

SEQ ID NO: 3013 - RNA, 19 nt, Artificial Sequence
  Synthetic oligonucleotide
gauaucaucaccaaguucc

SEQ ID NO: 3014 - RNA, 19 nt, Artificial Sequence
  Synthetic oligonucleotide
caaguuccuggaaaaugaa

SEQ ID NO: 3015 - RNA, 19 nt, Artificial Sequence
  Synthetic oligonucleotide
ccauuacuggaaccuauga

SEQ ID NO: 3016 - RNA, 19 nt, Artificial Sequence
  Synthetic oligonucleotide
cauuacuggaaccuaugau

SEQ ID NO: 3017 - RNA, 19 nt, Artificial Sequence
  Synthetic oligonucleotide
auuacuggaaccuaugauc

SEQ ID NO: 3018 - RNA, 19 nt, Artificial Sequence
  Synthetic oligonucleotide
uuacuggaaccuaugaucu

SEQ ID NO: 3019 - RNA, 19 nt, Artificial Sequence
  Synthetic oligonucleotide
uacuggaaccuaugaucug

SEQ ID NO: 3020 - RNA, 19 nt, Artificial Sequence
  Synthetic oligonucleotide
acuggaaccuaugaucuga

SEQ ID NO: 3021 - RNA, 19 nt, Artificial Sequence
  Synthetic oligonucleotide
cuggaaccuaugaucugaa

SEQ ID NO: 3022 - RNA, 19 nt, Artificial Sequence
  Synthetic oligonucleotide
uggaaccuaugaucugaag

SEQ ID NO: 3023 - RNA, 19 nt, Artificial Sequence
  Synthetic oligonucleotide
ggaaccuaugaucugaaga

SEQ ID NO: 3024 - RNA, 19 nt, Artificial Sequence
  Synthetic oligonucleotide
aucacuaaggucuucagca

SEQ ID NO: 3025 - RNA, 19 nt, Artificial Sequence
  Synthetic oligonucleotide
ucacuaaggucuucagcaa

SEQ ID NO: 3026 - RNA, 19 nt, Artificial Sequence
  Synthetic oligonucleotide
cacuaaggucuucagcaau

SEQ ID NO: 3027 - RNA, 19 nt, Artificial Sequence
  Synthetic oligonucleotide
cuaaggucuucagcaaugg

SEQ ID NO: 3028 - RNA, 19 nt, Artificial Sequence
  Synthetic oligonucleotide
uaaggucuucagcaauggg

SEQ ID NO: 3029 - RNA, 19 nt, Artificial Sequence
  Synthetic oligonucleotide
ugaagcucuccaaggccgu

SEQ ID NO: 3030 - RNA, 19 nt, Artificial Sequence
  Synthetic oligonucleotide
gaagcucuccaaggccgug

SEQ ID NO: 3031 - RNA, 19 nt, Artificial Sequence
  Synthetic oligonucleotide
aagcucuccaaggccgugc

SEQ ID NO: 3032 - RNA, 19 nt, Artificial Sequence
  Synthetic oligonucleotide
ccgaggucaaguucaacaa

SEQ ID NO: 3033 - RNA, 19 nt, Artificial Sequence
  Synthetic oligonucleotide
cgaggucaaguucaacaaa

SEQ ID NO: 3034 - RNA, 19 nt, Artificial Sequence
  Synthetic oligonucleotide
gaggucaaguucaacaaac

SEQ ID NO: 3035 - RNA, 19 nt, Artificial Sequence
  Synthetic oligonucleotide
aggucaaguucaacaaacc

SEQ ID NO: 3036 - RNA, 19 nt, Artificial Sequence
  Synthetic oligonucleotide
ggucaaguucaacaaaccc

SEQ ID NO: 3037 - RNA, 19 nt, Artificial Sequence
  Synthetic oligonucleotide
gucaaguucaacaaacccu

SEQ ID NO: 3038 - RNA, 19 nt, Artificial Sequence
  Synthetic oligonucleotide
ucaaguucaacaaacccuu

SEQ ID NO: 3039 - RNA, 19 nt, Artificial Sequence
  Synthetic oligonucleotide
caaguucaacaaacccuuu

SEQ ID NO: 3040 - RNA, 19 nt, Artificial Sequence
  Synthetic oligonucleotide
aaguucaacaaacccuuug

SEQ ID NO: 3041 - RNA, 19 nt, Artificial Sequence
  Synthetic oligonucleotide
aguucaacaaacccuuugu

SEQ ID NO: 3042 - RNA, 19 nt, Artificial Sequence
  Synthetic oligonucleotide
cccagggagaugcugccca

SEQ ID NO: 3043 - RNA, 19 nt, Artificial Sequence
  Synthetic oligonucleotide
ccagggagaugcugcccag

SEQ ID NO: 3044 - RNA, 19 nt, Artificial Sequence
  Synthetic oligonucleotide
cagggagaugcugcccaga

SEQ ID NO: 3045 - RNA, 19 nt, Artificial Sequence
  Synthetic oligonucleotide
agggagaugcugcccagaa

SEQ ID NO: 3046 - RNA, 19 nt, Artificial Sequence
  Synthetic oligonucleotide
gggagaugcugcccagaag

SEQ ID NO: 3047 - RNA, 19 nt, Artificial Sequence
  Synthetic oligonucleotide
ggagaugcugcccagaaga

SEQ ID NO: 3048 - RNA, 19 nt, Artificial Sequence
  Synthetic oligonucleotide
agauacaucccaccaugau

SEQ ID NO: 3049 - RNA, 19 nt, Artificial Sequence
  Synthetic oligonucleotide
gauacaucccaccaugauc

SEQ ID NO: 3050 - RNA, 19 nt, Artificial Sequence
  Synthetic oligonucleotide
auacaucccaccaugauca

SEQ ID NO: 3051 - RNA, 19 nt, Artificial Sequence
  Synthetic oligonucleotide
uacaucccaccaugaucag

SEQ ID NO: 3052 - RNA, 19 nt, Artificial Sequence
  Synthetic oligonucleotide
caccaguccaacagcacca

SEQ ID NO: 3053 - RNA, 19 nt, Artificial Sequence
  Synthetic oligonucleotide
accaguccaacagcaccaa

SEQ ID NO: 3054 - RNA, 19 nt, Artificial Sequence
  Synthetic oligonucleotide
ccaguccaacagcaccaau

SEQ ID NO: 3055 - RNA, 19 nt, Artificial Sequence
  Synthetic oligonucleotide
caguccaacagcaccaaua

SEQ ID NO: 3056 - RNA, 19 nt, Artificial Sequence
  Synthetic oligonucleotide
aguccaacagcaccaauau

SEQ ID NO: 3057 - RNA, 19 nt, Artificial Sequence
  Synthetic oligonucleotide
guccaacagcaccaauauc

SEQ ID NO: 3058 - RNA, 19 nt, Artificial Sequence
  Synthetic oligonucleotide
uccaacagcaccaauaucu

SEQ ID NO: 3059 - RNA, 19 nt, Artificial Sequence
  Synthetic oligonucleotide
ccaacagcaccaauaucuu

SEQ ID NO: 3060 - RNA, 19 nt, Artificial Sequence
  Synthetic oligonucleotide
caacagcaccaauaucuuc

SEQ ID NO: 3061 - RNA, 19 nt, Artificial Sequence
  Synthetic oligonucleotide
aacagcaccaauaucuucu

SEQ ID NO: 3062 - RNA, 19 nt, Artificial Sequence
  Synthetic oligonucleotide
acagcaccaauaucuucuu

SEQ ID NO: 3063 - RNA, 19 nt, Artificial Sequence
  Synthetic oligonucleotide
cagcaccaauaucuucuuc

SEQ ID NO: 3064 - RNA, 19 nt, Artificial Sequence
  Synthetic oligonucleotide
agcaccaauaucuucuucu

SEQ ID NO: 3065 - RNA, 19 nt, Artificial Sequence
  Synthetic oligonucleotide
gcaccaauaucuucuucuc

SEQ ID NO: 3066 - RNA, 19 nt, Artificial Sequence
  Synthetic oligonucleotide
caccaauaucuucuucucc

SEQ ID NO: 3067 - RNA, 19 nt, Artificial Sequence
  Synthetic oligonucleotide
ccccagugagcaucgcuac

SEQ ID NO: 3068 - RNA, 19 nt, Artificial Sequence
  Synthetic oligonucleotide
cccagugagcaucgcuaca

SEQ ID NO: 3069 - RNA, 19 nt, Artificial Sequence
  Synthetic oligonucleotide
ccagugagcaucgcuacag

SEQ ID NO: 3070 - RNA, 19 nt, Artificial Sequence
  Synthetic oligonucleotide
cagugagcaucgcuacagc

SEQ ID NO: 3071 - RNA, 19 nt, Artificial Sequence
  Synthetic oligonucleotide
agugagcaucgcuacagcc

SEQ ID NO: 3072 - RNA, 19 nt, Artificial Sequence
  Synthetic oligonucleotide
gugagcaucgcuacagccu

SEQ ID NO: 3073 - RNA, 19 nt, Artificial Sequence
  Synthetic oligonucleotide
ugagcaucgcuacagccuu

SEQ ID NO: 3074 - RNA, 19 nt, Artificial Sequence
  Synthetic oligonucleotide
gagcaucgcuacagccuuu

SEQ ID NO: 3075 - RNA, 19 nt, Artificial Sequence
  Synthetic oligonucleotide
agcaucgcuacagccuuug

SEQ ID NO: 3076 - RNA, 19 nt, Artificial Sequence
  Synthetic oligonucleotide
gcaucgcuacagccuuugc

SEQ ID NO: 3077 - RNA, 19 nt, Artificial Sequence
  Synthetic oligonucleotide
caucgcuacagccuuugca

SEQ ID NO: 3078 - RNA, 19 nt, Artificial Sequence
  Synthetic oligonucleotide
aucgcuacagccuuugcaa

SEQ ID NO: 3079 - RNA, 19 nt, Artificial Sequence
  Synthetic oligonucleotide
ucgcuacagccuuugcaau

SEQ ID NO: 3080 - RNA, 19 nt, Artificial Sequence
  Synthetic oligonucleotide
cgcuacagccuuugcaaug

SEQ ID NO: 3081 - RNA, 19 nt, Artificial Sequence
  Synthetic oligonucleotide
gcuacagccuuugcaaugc

SEQ ID NO: 3082 - RNA, 19 nt, Artificial Sequence
  Synthetic oligonucleotide
cuacagccuuugcaaugcu

SEQ ID NO: 3083 - RNA, 19 nt, Artificial Sequence
  Synthetic oligonucleotide
cccuggggaccaaggcuga

SEQ ID NO: 3084 - RNA, 19 nt, Artificial Sequence
  Synthetic oligonucleotide
ggggaccaaggcugacacu

SEQ ID NO: 3085 - RNA, 19 nt, Artificial Sequence
  Synthetic oligonucleotide
gggaccaaggcugacacuc

SEQ ID NO: 3086 - RNA, 19 nt, Artificial Sequence
  Synthetic oligonucleotide
ggaccaaggcugacacuca

SEQ ID NO: 3087 - RNA, 19 nt, Artificial Sequence
  Synthetic oligonucleotide
augaaauccuggagggccu

SEQ ID NO: 3088 - RNA, 19 nt, Artificial Sequence
  Synthetic oligonucleotide
ugaaauccuggagggccug

SEQ ID NO: 3089 - RNA, 19 nt, Artificial Sequence
  Synthetic oligonucleotide
auccaugaaggcuuccagg

SEQ ID NO: 3090 - RNA, 19 nt, Artificial Sequence
  Synthetic oligonucleotide
uccaugaaggcuuccagga

SEQ ID NO: 3091 - RNA, 19 nt, Artificial Sequence
  Synthetic oligonucleotide
gggacaccgaagaggccaa

SEQ ID NO: 3092 - RNA, 19 nt, Artificial Sequence
  Synthetic oligonucleotide
ggacaccgaagaggccaag

SEQ ID NO: 3093 - RNA, 19 nt, Artificial Sequence
  Synthetic oligonucleotide
gacaccgaagaggccaaga

SEQ ID NO: 3094 - RNA, 19 nt, Artificial Sequence
  Synthetic oligonucleotide
acaccgaagaggccaagaa

SEQ ID NO: 3095 - RNA, 19 nt, Artificial Sequence
  Synthetic oligonucleotide
caccgaagaggccaagaaa

SEQ ID NO: 3096 - RNA, 19 nt, Artificial Sequence
  Synthetic oligonucleotide
accgaagaggccaagaaac

SEQ ID NO: 3097 - RNA, 19 nt, Artificial Sequence
  Synthetic oligonucleotide
ccgaagaggccaagaaaca

SEQ ID NO: 3098 - RNA, 19 nt, Artificial Sequence
  Synthetic oligonucleotide
cgaagaggccaagaaacag

SEQ ID NO: 3099 - RNA, 19 nt, Artificial Sequence
  Synthetic oligonucleotide
gaagaggccaagaaacaga

SEQ ID NO: 3100 - RNA, 19 nt, Artificial Sequence
  Synthetic oligonucleotide
aagaggccaagaaacagau

SEQ ID NO: 3101 - RNA, 19 nt, Artificial Sequence
  Synthetic oligonucleotide
agaggccaagaaacagauc

SEQ ID NO: 3102 - RNA, 19 nt, Artificial Sequence
  Synthetic oligonucleotide
gaggccaagaaacagauca

SEQ ID NO: 3103 - RNA, 19 nt, Artificial Sequence
  Synthetic oligonucleotide
aggccaagaaacagaucaa

SEQ ID NO: 3104 - RNA, 19 nt, Artificial Sequence
  Synthetic oligonucleotide
uuuuugcucuggugaauua

SEQ ID NO: 3105 - RNA, 19 nt, Artificial Sequence
  Synthetic oligonucleotide
uuuugcucuggugaauuac

SEQ ID NO: 3106 - RNA, 19 nt, Artificial Sequence
  Synthetic oligonucleotide
uuugcucuggugaauuaca

SEQ ID NO: 3107 - RNA, 19 nt, Artificial Sequence
  Synthetic oligonucleotide
uugcucuggugaauuacau

SEQ ID NO: 3108 - RNA, 19 nt, Artificial Sequence
  Synthetic oligonucleotide
ugcucuggugaauuacauc

SEQ ID NO: 3109 - RNA, 19 nt, Artificial Sequence
  Synthetic oligonucleotide
gcucuggugaauuacaucu

SEQ ID NO: 3110 - RNA, 19 nt, Artificial Sequence
  Synthetic oligonucleotide
cucuggugaauuacaucuu

SEQ ID NO: 3111 - RNA, 19 nt, Artificial Sequence
  Synthetic oligonucleotide
ucuggugaauuacaucuuc

SEQ ID NO: 3112 - RNA, 19 nt, Artificial Sequence
  Synthetic oligonucleotide
cuggugaauuacaucuucu

SEQ ID NO: 3113 - RNA, 19 nt, Artificial Sequence
  Synthetic oligonucleotide
uggugaauuacaucuucuu

SEQ ID NO: 3114 - RNA, 19 nt, Artificial Sequence
  Synthetic oligonucleotide
ggugaauuacaucuucuuu

SEQ ID NO: 3115 - RNA, 19 nt, Artificial Sequence
  Synthetic oligonucleotide
gugaauuacaucuucuuua

SEQ ID NO: 3116 - RNA, 19 nt, Artificial Sequence
  Synthetic oligonucleotide
ugaauuacaucuucuuuaa

SEQ ID NO: 3117 - RNA, 19 nt, Artificial Sequence
  Synthetic oligonucleotide
gaauuacaucuucuuuaaa

SEQ ID NO: 3118 - RNA, 19 nt, Artificial Sequence
  Synthetic oligonucleotide
aauuacaucuucuuuaaag

SEQ ID NO: 3119 - RNA, 19 nt, Artificial Sequence
  Synthetic oligonucleotide
auuacaucuucuuuaaagg

SEQ ID NO: 3120 - RNA, 19 nt, Artificial Sequence
  Synthetic oligonucleotide
uuacaucuucuuuaaaggc

SEQ ID NO: 3121 - RNA, 19 nt, Artificial Sequence
  Synthetic oligonucleotide
uacaucuucuuuaaaggca

SEQ ID NO: 3122 - RNA, 19 nt, Artificial Sequence
  Synthetic oligonucleotide
acaucuucuuuaaaggcaa

SEQ ID NO: 3123 - RNA, 19 nt, Artificial Sequence
  Synthetic oligonucleotide
cuucuuuaaaggcaaaugg

SEQ ID NO: 3124 - RNA, 19 nt, Artificial Sequence
  Synthetic oligonucleotide
ucuuuaaaggcaaauggga

SEQ ID NO: 3125 - RNA, 19 nt, Artificial Sequence
  Synthetic oligonucleotide
ggcaaaugggagagacccu

SEQ ID NO: 3126 - RNA, 19 nt, Artificial Sequence
  Synthetic oligonucleotide
gcaaaugggagagacccuu

SEQ ID NO: 3127 - RNA, 19 nt, Artificial Sequence
  Synthetic oligonucleotide
caaaugggagagacccuuu

SEQ ID NO: 3128 - RNA, 19 nt, Artificial Sequence
  Synthetic oligonucleotide
aaaugggagagacccuuug

SEQ ID NO: 3129 - RNA, 19 nt, Artificial Sequence
  Synthetic oligonucleotide
cuguccagcugggugcugc

SEQ ID NO: 3130 - RNA, 19 nt, Artificial Sequence
  Synthetic oligonucleotide
uguccagcugggugcugcu

SEQ ID NO: 3131 - RNA, 19 nt, Artificial Sequence
  Synthetic oligonucleotide
guccagcugggugcugcug

SEQ ID NO: 3132 - RNA, 19 nt, Artificial Sequence
  Synthetic oligonucleotide
uccagcugggugcugcuga

SEQ ID NO: 3133 - RNA, 19 nt, Artificial Sequence
  Synthetic oligonucleotide
ccagcugggugcugcugau

SEQ ID NO: 3134 - RNA, 19 nt, Artificial Sequence
  Synthetic oligonucleotide
cagcugggugcugcugaug

SEQ ID NO: 3135 - RNA, 19 nt, Artificial Sequence
  Synthetic oligonucleotide
agcugggugcugcugauga

SEQ ID NO: 3136 - RNA, 19 nt, Artificial Sequence
  Synthetic oligonucleotide
gcugggugcugcugaugaa

SEQ ID NO: 3137 - RNA, 19 nt, Artificial Sequence
  Synthetic oligonucleotide
cugggugcugcugaugaaa

SEQ ID NO: 3138 - RNA, 19 nt, Artificial Sequence
  Synthetic oligonucleotide
ugggugcugcugaugaaau

SEQ ID NO: 3139 - RNA, 19 nt, Artificial Sequence
  Synthetic oligonucleotide
ggugcugcugaugaaauac

SEQ ID NO: 3140 - RNA, 19 nt, Artificial Sequence
  Synthetic oligonucleotide
gugcugcugaugaaauacc

SEQ ID NO: 3141 - RNA, 19 nt, Artificial Sequence
  Synthetic oligonucleotide
ugcugcugaugaaauaccu

SEQ ID NO: 3142 - RNA, 19 nt, Artificial Sequence
  Synthetic oligonucleotide
gcugcugaugaaauaccug

SEQ ID NO: 3143 - RNA, 19 nt, Artificial Sequence
  Synthetic oligonucleotide
cugcugaugaaauaccugg

SEQ ID NO: 3144 - RNA, 19 nt, Artificial Sequence
  Synthetic oligonucleotide
ugcugaugaaauaccuggg

SEQ ID NO: 3145 - RNA, 19 nt, Artificial Sequence
  Synthetic oligonucleotide
gcugaugaaauaccugggc

SEQ ID NO: 3146 - RNA, 19 nt, Artificial Sequence
  Synthetic oligonucleotide
cugaugaaauaccugggca

SEQ ID NO: 3147 - RNA, 19 nt, Artificial Sequence
  Synthetic oligonucleotide
ugaugaaauaccugggcaa

SEQ ID NO: 3148 - RNA, 19 nt, Artificial Sequence
  Synthetic oligonucleotide
gaugaaauaccugggcaau

SEQ ID NO: 3149 - RNA, 19 nt, Artificial Sequence
  Synthetic oligonucleotide
ugaaauaccugggcaaugc

SEQ ID NO: 3150 - RNA, 19 nt, Artificial Sequence
  Synthetic oligonucleotide
acagcaccuggaaaaugaa

SEQ ID NO: 3151 - RNA, 19 nt, Artificial Sequence
  Synthetic oligonucleotide
ccuggaaaaugaacucacc

SEQ ID NO: 3152 - RNA, 19 nt, Artificial Sequence
  Synthetic oligonucleotide
cuggaaaaugaacucaccc

SEQ ID NO: 3153 - RNA, 19 nt, Artificial Sequence
  Synthetic oligonucleotide
cgauaucaucaccaaguuc

SEQ ID NO: 3154 - RNA, 19 nt, Artificial Sequence
  Synthetic oligonucleotide
ccaaguuccuggaaaauga

SEQ ID NO: 3155 - RNA, 19 nt, Artificial Sequence
  Synthetic oligonucleotide
uccauuacuggaaccuaug

SEQ ID NO: 3156 - RNA, 19 nt, Artificial Sequence
  Synthetic oligonucleotide
ccauuacuggaaccuauga

SEQ ID NO: 3157 - RNA, 19 nt, Artificial Sequence
  Synthetic oligonucleotide
cauuacuggaaccuaugau

SEQ ID NO: 3158 - RNA, 19 nt, Artificial Sequence
  Synthetic oligonucleotide
auuacuggaaccuaugauc

SEQ ID NO: 3159 - RNA, 19 nt, Artificial Sequence
  Synthetic oligonucleotide
uuacuggaaccuaugaucu

SEQ ID NO: 3160 - RNA, 19 nt, Artificial Sequence
  Synthetic oligonucleotide
uacuggaaccuaugaucug

SEQ ID NO: 3161 - RNA, 19 nt, Artificial Sequence
  Synthetic oligonucleotide
acuggaaccuaugaucuga

SEQ ID NO: 3162 - RNA, 19 nt, Artificial Sequence
  Synthetic oligonucleotide
cuggaaccuaugaucugaa

SEQ ID NO: 3163 - RNA, 19 nt, Artificial Sequence
  Synthetic oligonucleotide
uggaaccuaugaucugaag

SEQ ID NO: 3164 - RNA, 19 nt, Artificial Sequence
  Synthetic oligonucleotide
caucacuaaggucuucagc

SEQ ID NO: 3165 - RNA, 19 nt, Artificial Sequence
  Synthetic oligonucleotide
aucacuaaggucuucagca

SEQ ID NO: 3166 - RNA, 19 nt, Artificial Sequence
  Synthetic oligonucleotide
ucacuaaggucuucagcaa

SEQ ID NO: 3167 - RNA, 19 nt, Artificial Sequence
  Synthetic oligonucleotide
acuaaggucuucagcaaug

SEQ ID NO: 3168 - RNA, 19 nt, Artificial Sequence
  Synthetic oligonucleotide
cuaaggucuucagcaaugg

SEQ ID NO: 3169 - RNA, 19 nt, Artificial Sequence
  Synthetic oligonucleotide
cugaagcucuccaaggccg

SEQ ID NO: 3170 - RNA, 19 nt, Artificial Sequence
  Synthetic oligonucleotide
ugaagcucuccaaggccgu

SEQ ID NO: 3171 - RNA, 19 nt, Artificial Sequence
  Synthetic oligonucleotide
gaagcucuccaaggccgug

SEQ ID NO: 3172 - RNA, 19 nt, Artificial Sequence
  Synthetic oligonucleotide
cccgaggucaaguucaaca

SEQ ID NO: 3173 - RNA, 19 nt, Artificial Sequence
  Synthetic oligonucleotide
ccgaggucaaguucaacaa

SEQ ID NO: 3174 - RNA, 19 nt, Artificial Sequence
  Synthetic oligonucleotide
cgaggucaaguucaacaaa

SEQ ID NO: 3175 - RNA, 19 nt, Artificial Sequence
  Synthetic oligonucleotide
gaggucaaguucaacaaac

SEQ ID NO: 3176 - RNA, 19 nt, Artificial Sequence
  Synthetic oligonucleotide
aggucaaguucaacaaacc

SEQ ID NO: 3177 - RNA, 19 nt, Artificial Sequence
  Synthetic oligonucleotide
ggucaaguucaacaaaccc

SEQ ID NO: 3178 - RNA, 19 nt, Artificial Sequence
  Synthetic oligonucleotide
gucaaguucaacaaacccu

SEQ ID NO: 3179 - RNA, 19 nt, Artificial Sequence
  Synthetic oligonucleotide
ucaaguucaacaaacccuu

SEQ ID NO: 3180 - RNA, 19 nt, Artificial Sequence
  Synthetic oligonucleotide
caaguucaacaaacccuuu

SEQ ID NO: 3181 - RNA, 19 nt, Artificial Sequence
  Synthetic oligonucleotide
aaguucaacaaacccuuug

SEQ ID NO: 3182 - RNA, 19 nt, Artificial Sequence
  Synthetic oligonucleotide
ccccagggagaugcugccc

SEQ ID NO: 3183 - RNA, 19 nt, Artificial Sequence
  Synthetic oligonucleotide
cccagggagaugcugccca

SEQ ID NO: 3184 - RNA, 19 nt, Artificial Sequence
  Synthetic oligonucleotide
ccagggagaugcugcccag

SEQ ID NO: 3185 - RNA, 19 nt, Artificial Sequence
  Synthetic oligonucleotide
cagggagaugcugcccaga

SEQ ID NO: 3186 - RNA, 19 nt, Artificial Sequence
  Synthetic oligonucleotide
agggagaugcugcccagaa

SEQ ID NO: 3187 - RNA, 19 nt, Artificial Sequence
  Synthetic oligonucleotide
gggagaugcugcccagaag

SEQ ID NO: 3188 - RNA, 19 nt, Artificial Sequence
  Synthetic oligonucleotide
cagauacaucccaccauga

SEQ ID NO: 3189 - RNA, 19 nt, Artificial Sequence
  Synthetic oligonucleotide
agauacaucccaccaugau

SEQ ID NO: 3190 - RNA, 19 nt, Artificial Sequence
  Synthetic oligonucleotide
gauacaucccaccaugauc

SEQ ID NO: 3191 - RNA, 19 nt, Artificial Sequence
  Synthetic oligonucleotide
auacaucccaccaugauca

SEQ ID NO: 3192 - RNA, 19 nt, Artificial Sequence
  Synthetic oligonucleotide
acaccaguccaacagcacc

SEQ ID NO: 3193 - RNA, 19 nt, Artificial Sequence
  Synthetic oligonucleotide
caccaguccaacagcacca

SEQ ID NO: 3194 - RNA, 19 nt, Artificial Sequence
  Synthetic oligonucleotide
accaguccaacagcaccaa

SEQ ID NO: 3195 - RNA, 19 nt, Artificial Sequence
  Synthetic oligonucleotide
ccaguccaacagcaccaau

SEQ ID NO: 3196 - RNA, 19 nt, Artificial Sequence
  Synthetic oligonucleotide
caguccaacagcaccaaua

SEQ ID NO: 3197 - RNA, 19 nt, Artificial Sequence
  Synthetic oligonucleotide
aguccaacagcaccaauau

SEQ ID NO: 3198 - RNA, 19 nt, Artificial Sequence
  Synthetic oligonucleotide
guccaacagcaccaauauc

SEQ ID NO: 3199 - RNA, 19 nt, Artificial Sequence
  Synthetic oligonucleotide
uccaacagcaccaauaucu

SEQ ID NO: 3200 - RNA, 19 nt, Artificial Sequence
  Synthetic oligonucleotide
ccaacagcaccaauaucuu

SEQ ID NO: 3201 - RNA, 19 nt, Artificial Sequence
  Synthetic oligonucleotide
caacagcaccaauaucuuc

SEQ ID NO: 3202 - RNA, 19 nt, Artificial Sequence
  Synthetic oligonucleotide
aacagcaccaauaucuucu

SEQ ID NO: 3203 - RNA, 19 nt, Artificial Sequence
  Synthetic oligonucleotide
acagcaccaauaucuucuu

SEQ ID NO: 3204 - RNA, 19 nt, Artificial Sequence
  Synthetic oligonucleotide
cagcaccaauaucuucuuc

SEQ ID NO: 3205 - RNA, 19 nt, Artificial Sequence
  Synthetic oligonucleotide
agcaccaauaucuucuucu

SEQ ID NO: 3206 - RNA, 19 nt, Artificial Sequence
  Synthetic oligonucleotide
gcaccaauaucuucuucuc

SEQ ID NO: 3207 - RNA, 19 nt, Artificial Sequence
  Synthetic oligonucleotide
uccccagugagcaucgcua

SEQ ID NO: 3208 - RNA, 19 nt, Artificial Sequence
  Synthetic oligonucleotide
ccccagugagcaucgcuac

SEQ ID NO: 3209 - RNA, 19 nt, Artificial Sequence
  Synthetic oligonucleotide
cccagugagcaucgcuaca

SEQ ID NO: 3210 - RNA, 19 nt, Artificial Sequence
  Synthetic oligonucleotide
ccagugagcaucgcuacag

SEQ ID NO: 3211 - RNA, 19 nt, Artificial Sequence
  Synthetic oligonucleotide
cagugagcaucgcuacagc

SEQ ID NO: 3212 - RNA, 19 nt, Artificial Sequence
  Synthetic oligonucleotide
agugagcaucgcuacagcc

SEQ ID NO: 3213 - RNA, 19 nt, Artificial Sequence
  Synthetic oligonucleotide
gugagcaucgcuacagccu

SEQ ID NO: 3214 - RNA, 19 nt, Artificial Sequence
  Synthetic oligonucleotide
ugagcaucgcuacagccuu

SEQ ID NO: 3215 - RNA, 19 nt, Artificial Sequence
  Synthetic oligonucleotide
gagcaucgcuacagccuuu

SEQ ID NO: 3216 - RNA, 19 nt, Artificial Sequence
  Synthetic oligonucleotide
agcaucgcuacagccuuug

SEQ ID NO: 3217 - RNA, 19 nt, Artificial Sequence
  Synthetic oligonucleotide
gcaucgcuacagccuuugc

SEQ ID NO: 3218 - RNA, 19 nt, Artificial Sequence
  Synthetic oligonucleotide
caucgcuacagccuuugca

SEQ ID NO: 3219 - RNA, 19 nt, Artificial Sequence
  Synthetic oligonucleotide
aucgcuacagccuuugcaa

SEQ ID NO: 3220 - RNA, 19 nt, Artificial Sequence
  Synthetic oligonucleotide
ucgcuacagccuuugcaau

SEQ ID NO: 3221 - RNA, 19 nt, Artificial Sequence
  Synthetic oligonucleotide
cgcuacagccuuugcaaug

SEQ ID NO: 3222 - RNA, 19 nt, Artificial Sequence
  Synthetic oligonucleotide
gcuacagccuuugcaaugc

SEQ ID NO: 3223 - RNA, 19 nt, Artificial Sequence
  Synthetic oligonucleotide
ucccuggggaccaaggcug

SEQ ID NO: 3224 - RNA, 19 nt, Artificial Sequence
  Synthetic oligonucleotide
uggggaccaaggcugacac

SEQ ID NO: 3225 - RNA, 19 nt, Artificial Sequence
  Synthetic oligonucleotide
ggggaccaaggcugacacu

SEQ ID NO: 3226 - RNA, 19 nt, Artificial Sequence
  Synthetic oligonucleotide
gggaccaaggcugacacuc

SEQ ID NO: 3227 - RNA, 19 nt, Artificial Sequence
  Synthetic oligonucleotide
gaugaaauccuggagggcc

SEQ ID NO: 3228 - RNA, 19 nt, Artificial Sequence
  Synthetic oligonucleotide
augaaauccuggagggccu

SEQ ID NO: 3229 - RNA, 19 nt, Artificial Sequence
  Synthetic oligonucleotide
gauccaugaaggcuuccag

SEQ ID NO: 3230 - RNA, 19 nt, Artificial Sequence
  Synthetic oligonucleotide
auccaugaaggcuuccagg

SEQ ID NO: 3231 - RNA, 19 nt, Artificial Sequence
  Synthetic oligonucleotide
ggggacaccgaagaggcca

SEQ ID NO: 3232 - RNA, 19 nt, Artificial Sequence
  Synthetic oligonucleotide
gggacaccgaagaggccaa

SEQ ID NO: 3233 - RNA, 19 nt, Artificial Sequence
  Synthetic oligonucleotide
ggacaccgaagaggccaag

SEQ ID NO: 3234 - RNA, 19 nt, Artificial Sequence
  Synthetic oligonucleotide
gacaccgaagaggccaaga

SEQ ID NO: 3235 - RNA, 19 nt, Artificial Sequence
  Synthetic oligonucleotide
acaccgaagaggccaagaa

SEQ ID NO: 3236 - RNA, 19 nt, Artificial Sequence
  Synthetic oligonucleotide
caccgaagaggccaagaaa

SEQ ID NO: 3237 - RNA, 19 nt, Artificial Sequence
  Synthetic oligonucleotide
accgaagaggccaagaaac

SEQ ID NO: 3238 - RNA, 19 nt, Artificial Sequence
  Synthetic oligonucleotide
ccgaagaggccaagaaaca

SEQ ID NO: 3239 - RNA, 19 nt, Artificial Sequence
  Synthetic oligonucleotide
cgaagaggccaagaaacag

SEQ ID NO: 3240 - RNA, 19 nt, Artificial Sequence
  Synthetic oligonucleotide
gaagaggccaagaaacaga

SEQ ID NO: 3241 - RNA, 19 nt, Artificial Sequence
  Synthetic oligonucleotide
aagaggccaagaaacagau

SEQ ID NO: 3242 - RNA, 19 nt, Artificial Sequence
  Synthetic oligonucleotide
agaggccaagaaacagauc

SEQ ID NO: 3243 - RNA, 19 nt, Artificial Sequence
  Synthetic oligonucleotide
gaggccaagaaacagauca

SEQ ID NO: 3244 - RNA, 19 nt, Artificial Sequence
  Synthetic oligonucleotide
guuuuugcucuggugaauu

SEQ ID NO: 3245 - RNA, 19 nt, Artificial Sequence
  Synthetic oligonucleotide
uuuuugcucuggugaauua

SEQ ID NO: 3246 - RNA, 19 nt, Artificial Sequence
  Synthetic oligonucleotide
uuuugcucuggugaauuac

SEQ ID NO: 3247 - RNA, 19 nt, Artificial Sequence
  Synthetic oligonucleotide
uuugcucuggugaauuaca

SEQ ID NO: 3248 - RNA, 19 nt, Artificial Sequence
  Synthetic oligonucleotide
uugcucuggugaauuacau

SEQ ID NO: 3249 - RNA, 19 nt, Artificial Sequence
  Synthetic oligonucleotide
ugcucuggugaauuacauc

SEQ ID NO: 3250 - RNA, 19 nt, Artificial Sequence
  Synthetic oligonucleotide
gcucuggugaauuacaucu

SEQ ID NO: 3251 - RNA, 19 nt, Artificial Sequence
  Synthetic oligonucleotide
cucuggugaauuacaucuu

SEQ ID NO: 3252 - RNA, 19 nt, Artificial Sequence
  Synthetic oligonucleotide
ucuggugaauuacaucuuc

SEQ ID NO: 3253 - RNA, 19 nt, Artificial Sequence
  Synthetic oligonucleotide
cuggugaauuacaucuucu

SEQ ID NO: 3254 - RNA, 19 nt, Artificial Sequence
  Synthetic oligonucleotide
uggugaauuacaucuucuu

SEQ ID NO: 3255 - RNA, 19 nt, Artificial Sequence
  Synthetic oligonucleotide
ggugaauuacaucuucuuu

SEQ ID NO: 3256 - RNA, 19 nt, Artificial Sequence
  Synthetic oligonucleotide
gugaauuacaucuucuuua

SEQ ID NO: 3257 - RNA, 19 nt, Artificial Sequence
  Synthetic oligonucleotide
ugaauuacaucuucuuuaa

SEQ ID NO: 3258 - RNA, 19 nt, Artificial Sequence
  Synthetic oligonucleotide
gaauuacaucuucuuuaaa

SEQ ID NO: 3259 - RNA, 19 nt, Artificial Sequence
  Synthetic oligonucleotide
aauuacaucuucuuuaaag

SEQ ID NO: 3260 - RNA, 19 nt, Artificial Sequence
  Synthetic oligonucleotide
auuacaucuucuuuaaagg

SEQ ID NO: 3261 - RNA, 19 nt, Artificial Sequence
  Synthetic oligonucleotide
uuacaucuucuuuaaaggc

SEQ ID NO: 3262 - RNA, 19 nt, Artificial Sequence
  Synthetic oligonucleotide
uacaucuucuuuaaaggca

SEQ ID NO: 3263 - RNA, 19 nt, Artificial Sequence
  Synthetic oligonucleotide
ucuucuuuaaaggcaaaug

SEQ ID NO: 3264 - RNA, 19 nt, Artificial Sequence
  Synthetic oligonucleotide
uucuuuaaaggcaaauggg

SEQ ID NO: 3265 - RNA, 19 nt, Artificial Sequence
  Synthetic oligonucleotide
aggcaaaugggagagaccc

SEQ ID NO: 3266 - RNA, 19 nt, Artificial Sequence
  Synthetic oligonucleotide
ggcaaaugggagagacccu

SEQ ID NO: 3267 - RNA, 19 nt, Artificial Sequence
  Synthetic oligonucleotide
gcaaaugggagagacccuu

SEQ ID NO: 3268 - RNA, 19 nt, Artificial Sequence
  Synthetic oligonucleotide
caaaugggagagacccuuu

SEQ ID NO: 3269 - RNA, 19 nt, Artificial Sequence
  Synthetic oligonucleotide
gcuguccagcugggugcug

SEQ ID NO: 3270 - RNA, 19 nt, Artificial Sequence
  Synthetic oligonucleotide
cuguccagcugggugcugc

SEQ ID NO: 3271 - RNA, 19 nt, Artificial Sequence
  Synthetic oligonucleotide
uguccagcugggugcugcu

SEQ ID NO: 3272 - RNA, 19 nt, Artificial Sequence
  Synthetic oligonucleotide
guccagcugggugcugcug

SEQ ID NO: 3273 - RNA, 19 nt, Artificial Sequence
  Synthetic oligonucleotide
uccagcugggugcugcuga

SEQ ID NO: 3274 - RNA, 19 nt, Artificial Sequence
  Synthetic oligonucleotide
ccagcugggugcugcugau

SEQ ID NO: 3275 - RNA, 19 nt, Artificial Sequence
  Synthetic oligonucleotide
cagcugggugcugcugaug

SEQ ID NO: 3276 - RNA, 19 nt, Artificial Sequence
  Synthetic oligonucleotide
agcugggugcugcugauga

SEQ ID NO: 3277 - RNA, 19 nt, Artificial Sequence
  Synthetic oligonucleotide
gcugggugcugcugaugaa

SEQ ID NO: 3278 - RNA, 19 nt, Artificial Sequence
  Synthetic oligonucleotide
cugggugcugcugaugaaa

SEQ ID NO: 3279 - RNA, 19 nt, Artificial Sequence
  Synthetic oligonucleotide
gggugcugcugaugaaaua

SEQ ID NO: 3280 - RNA, 19 nt, Artificial Sequence
  Synthetic oligonucleotide
ggugcugcugaugaaauac

SEQ ID NO: 3281 - RNA, 19 nt, Artificial Sequence
  Synthetic oligonucleotide
gugcugcugaugaaauacc

SEQ ID NO: 3282 - RNA, 19 nt, Artificial Sequence
  Synthetic oligonucleotide
ugcugcugaugaaauaccu

SEQ ID NO: 3283 - RNA, 19 nt, Artificial Sequence
  Synthetic oligonucleotide
gcugcugaugaaauaccug

SEQ ID NO: 3284 - RNA, 19 nt, Artificial Sequence
  Synthetic oligonucleotide
cugcugaugaaauaccugg

SEQ ID NO: 3285 - RNA, 19 nt, Artificial Sequence
  Synthetic oligonucleotide
ugcugaugaaauaccuggg

SEQ ID NO: 3286 - RNA, 19 nt, Artificial Sequence
  Synthetic oligonucleotide
gcugaugaaauaccugggc

SEQ ID NO: 3287 - RNA, 19 nt, Artificial Sequence
  Synthetic oligonucleotide
cugaugaaauaccugggca

SEQ ID NO: 3288 - RNA, 19 nt, Artificial Sequence
  Synthetic oligonucleotide
ugaugaaauaccugggcaa

SEQ ID NO: 3289 - RNA, 19 nt, Artificial Sequence
  Synthetic oligonucleotide
augaaauaccugggcaaug

SEQ ID NO: 3290 - RNA, 19 nt, Artificial Sequence
  Synthetic oligonucleotide
uacagcaccuggaaaauga

SEQ ID NO: 3291 - RNA, 19 nt, Artificial Sequence
  Synthetic oligonucleotide
accuggaaaaugaacucac

SEQ ID NO: 3292 - RNA, 19 nt, Artificial Sequence
  Synthetic oligonucleotide
ccuggaaaaugaacucacc

SEQ ID NO: 3293 - RNA, 19 nt, Artificial Sequence
  Synthetic oligonucleotide
acgauaucaucaccaaguu

SEQ ID NO: 3294 - RNA, 19 nt, Artificial Sequence
  Synthetic oligonucleotide
accaaguuccuggaaaaug

SEQ ID NO: 3295 - RNA, 19 nt, Artificial Sequence
  Synthetic oligonucleotide
guccauuacuggaaccuau

SEQ ID NO: 3296 - RNA, 19 nt, Artificial Sequence
  Synthetic oligonucleotide
uccauuacuggaaccuaug

SEQ ID NO: 3297 - RNA, 19 nt, Artificial Sequence
  Synthetic oligonucleotide
ccauuacuggaaccuauga

SEQ ID NO: 3298 - RNA, 19 nt, Artificial Sequence
  Synthetic oligonucleotide
cauuacuggaaccuaugau

SEQ ID NO: 3299 - RNA, 19 nt, Artificial Sequence
  Synthetic oligonucleotide
auuacuggaaccuaugauc

SEQ ID NO: 3300 - RNA, 19 nt, Artificial Sequence
  Synthetic oligonucleotide
uuacuggaaccuaugaucu

SEQ ID NO: 3301 - RNA, 19 nt, Artificial Sequence
  Synthetic oligonucleotide
uacuggaaccuaugaucug

SEQ ID NO: 3302 - RNA, 19 nt, Artificial Sequence
  Synthetic oligonucleotide
acuggaaccuaugaucuga

SEQ ID NO: 3303 - RNA, 19 nt, Artificial Sequence
  Synthetic oligonucleotide
cuggaaccuaugaucugaa

SEQ ID NO: 3304 - RNA, 19 nt, Artificial Sequence
  Synthetic oligonucleotide
gcaucacuaaggucuucag

SEQ ID NO: 3305 - RNA, 19 nt, Artificial Sequence
  Synthetic oligonucleotide
caucacuaaggucuucagc

SEQ ID NO: 3306 - RNA, 19 nt, Artificial Sequence
  Synthetic oligonucleotide
aucacuaaggucuucagca

SEQ ID NO: 3307 - RNA, 19 nt, Artificial Sequence
  Synthetic oligonucleotide
cacuaaggucuucagcaau

SEQ ID NO: 3308 - RNA, 19 nt, Artificial Sequence
  Synthetic oligonucleotide
acuaaggucuucagcaaug

SEQ ID NO: 3309 - RNA, 19 nt, Artificial Sequence
  Synthetic oligonucleotide
ccugaagcucuccaaggcc

SEQ ID NO: 3310 - RNA, 19 nt, Artificial Sequence
  Synthetic oligonucleotide
cugaagcucuccaaggccg

SEQ ID NO: 3311 - RNA, 19 nt, Artificial Sequence
  Synthetic oligonucleotide
ugaagcucuccaaggccgu

SEQ ID NO: 3312 - RNA, 19 nt, Artificial Sequence
  Synthetic oligonucleotide
ccccgaggucaaguucaac

SEQ ID NO: 3313 - RNA, 19 nt, Artificial Sequence
  Synthetic oligonucleotide
cccgaggucaaguucaaca

SEQ ID NO: 3314 - RNA, 19 nt, Artificial Sequence
  Synthetic oligonucleotide
ccgaggucaaguucaacaa

SEQ ID NO: 3315 - RNA, 19 nt, Artificial Sequence
  Synthetic oligonucleotide
cgaggucaaguucaacaaa

SEQ ID NO: 3316 - RNA, 19 nt, Artificial Sequence
  Synthetic oligonucleotide
gaggucaaguucaacaaac

SEQ ID NO: 3317 - RNA, 19 nt, Artificial Sequence
  Synthetic oligonucleotide
aggucaaguucaacaaacc

SEQ ID NO: 3318 - RNA, 19 nt, Artificial Sequence
  Synthetic oligonucleotide
ggucaaguucaacaaaccc

SEQ ID NO: 3319 - RNA, 19 nt, Artificial Sequence
  Synthetic oligonucleotide
gucaaguucaacaaacccu

SEQ ID NO: 3320 - RNA, 19 nt, Artificial Sequence
  Synthetic oligonucleotide
ucaaguucaacaaacccuu

SEQ ID NO: 3321 - RNA, 19 nt, Artificial Sequence
  Synthetic oligonucleotide
caaguucaacaaacccuuu

SEQ ID NO: 3322 - RNA, 21 nt, Artificial Sequence
  Synthetic oligonucleotide
cucacuggggagaagaagaua

SEQ ID NO: 3323 - RNA, 19 nt, Artificial Sequence
  Synthetic oligonucleotide
ucuucuucuccccagugag

SEQ ID NO: 3324 - RNA, 27 nt, Artificial Sequence
  Synthetic oligonucleotide
uaucuucuucuccccagugagcaucaa

SEQ ID NO: 3325 - RNA, 21 nt, Artificial Sequence
  Synthetic oligonucleotide
uaucuucuucuccccagugca

SEQ ID NO: 3326 - DNA, 25 bp, Artificial Sequence
  Synthetic oligonucleotide
ucuucuucuccccagugaacaucgc

SEQ ID NO: 3327 - DNA, 25 bp, Artificial Sequence
  Synthetic oligonucleotide
ucuucuucuccccagugaguaucgc

SEQ ID NO: 3328 - DNA, 25 bp, Artificial Sequence
  Synthetic oligonucleotide
ucuucuucuccccagugagcuucgc

SEQ ID NO: 3329 - DNA, 25 bp, Artificial Sequence
  Synthetic oligonucleotide
ucuucuucuccccagugagcagcgc

SEQ ID NO: 3330 - DNA, 25 bp, Artificial Sequence
  Synthetic oligonucleotide
ucuucuucuccccagugagcauagc

SEQ ID NO: 3331 - DNA, 25 bp, Artificial Sequence
  Synthetic oligonucleotide
ucuucuucuccccagugagcauctc

SEQ ID NO: 3332 - DNA, 25 bp, Artificial Sequence
  Synthetic oligonucleotide
ucuucuucuccccagugagcaucga

SEQ ID NO: 3333 - RNA, 27 nt, Artificial Sequence
  Synthetic oligonucleotide
ucgaugcucacuggggagaagaagaua

SEQ ID NO: 3334 - RNA, 27 nt, Artificial Sequence
  Synthetic oligonucleotide
gagaugcucacuggggagaagaagaua

SEQ ID NO: 3335 - RNA, 27 nt, Artificial Sequence
  Synthetic oligonucleotide
gcuaugcucacuggggagaagaagaua

SEQ ID NO: 3336 - RNA, 27 nt, Artificial Sequence
  Synthetic oligonucleotide
gcgcugcucacuggggagaagaagaua

SEQ ID NO: 3337 - RNA, 27 nt, Artificial Sequence
  Synthetic oligonucleotide
gcgaagcucacuggggagaagaagaua

SEQ ID NO: 3338 - RNA, 27 nt, Artificial Sequence
  Synthetic oligonucleotide
gcgauacucacuggggagaagaagaua

SEQ ID NO: 3339 - RNA, 27 nt, Artificial Sequence
  Synthetic oligonucleotide
gcgauguucacuggggagaagaagaua

SEQ ID NO: 3340 - DNA, 25 bp, Artificial Sequence
  Synthetic oligonucleotide
gcuguccagcugggugcuacugatg

SEQ ID NO: 3341 - DNA, 25 bp, Artificial Sequence
  Synthetic oligonucleotide
gcuguccagcugggugcuguugatg

SEQ ID NO: 3342 - DNA, 25 bp, Artificial Sequence
  Synthetic oligonucleotide
gcuguccagcugggugcugcagatg

SEQ ID NO: 3343 - DNA, 25 bp, Artificial Sequence
  Synthetic oligonucleotide
gcuguccagcugggugcugcuuatg

SEQ ID NO: 3344 - DNA, 25 bp, Artificial Sequence
  Synthetic oligonucleotide
gcuguccagcugggugcugcugutg

SEQ ID NO: 3345 - DNA, 25 bp, Artificial Sequence
  Synthetic oligonucleotide
gcuguccagcugggugcugcugagg

SEQ ID NO: 3346 - DNA, 25 bp, Artificial Sequence
  Synthetic oligonucleotide
gcuguccagcugggugcugcugata

SEQ ID NO: 3347 - RNA, 27 nt, Artificial Sequence
  Synthetic oligonucleotide
uaucagcagcacccagcuggacagcuu

SEQ ID NO: 3348 - RNA, 27 nt, Artificial Sequence
  Synthetic oligonucleotide
ccucagcagcacccagcuggacagcuu

SEQ ID NO: 3349 - RNA, 27 nt, Artificial Sequence
  Synthetic oligonucleotide
caacagcagcacccagcuggacagcuu

SEQ ID NO: 3350 - RNA, 27 nt, Artificial Sequence
  Synthetic oligonucleotide
cauaagcagcacccagcuggacagcuu

SEQ ID NO: 3351 - RNA, 27 nt, Artificial Sequence
  Synthetic oligonucleotide
caucugcagcacccagcuggacagcuu

SEQ ID NO: 3352 - RNA, 27 nt, Artificial Sequence
  Synthetic oligonucleotide
caucaacagcacccagcuggacagcuu

SEQ ID NO: 3353 - RNA, 27 nt, Artificial Sequence
  Synthetic oligonucleotide
caucaguagcacccagcuggacagcuu

SEQ ID NO: 3354 - RNA, 25 nt, Artificial Sequence
  Synthetic oligonucleotide
  misc_feature (19)..(25): n is a, c, g, or u
ucuucuucuccccagugannnnnnn

SEQ ID NO: 3355 - RNA, 27 nt, Artificial Sequence
  Synthetic oligonucleotide
  misc_feature (1)..(7): n is a, c, g, or u
nnnnnnnucacuggggagaagaagaua

SEQ ID NO: 3356 - RNA, 27 nt, Artificial Sequence
  Synthetic oligonucleotide
  misc_feature (21)..(27): n is a, c, g, or u
uaucuucuucuccccagugannnnnnn

SEQ ID NO: 3357 - RNA, 34 nt, Artificial Sequence
  Synthetic oligonucleotide
caccaauaucuucuucuccccagugagcaucgcu

SEQ ID NO: 3358 - DNA, 25 bp, Artificial Sequence
  Synthetic oligonucleotide
ccccagggagaugcugcccagaaga

SEQ ID NO: 3359 - RNA, 27 nt, Artificial Sequence
  Synthetic oligonucleotide
ucuucugggcagcaucucccuggggau

SEQ ID NO: 3360 - DNA, 27 bp, Artificial Sequence
  Synthetic oligonucleotide
atccccagggagatgctgcccagaaga

SEQ ID NO: 3361 - DNA, 25 bp, Artificial Sequence
  Synthetic oligonucleotide
gccuuugcaaugcucucccugggga

SEQ ID NO: 3362 - RNA, 27 nt, Artificial Sequence
  Synthetic oligonucleotide
uccccagggagagcauugcaaaggcug

SEQ ID NO: 3363 - DNA, 27 bp, Artificial Sequence
  Synthetic oligonucleotide
cagcctttgcaatgctctccctgggga

SEQ ID NO: 3364 - DNA, 25 bp, Artificial Sequence
  Synthetic oligonucleotide
gcaaugcucucccuggggaccaagg

SEQ ID NO: 3365 - RNA, 27 nt, Artificial Sequence
  Synthetic oligonucleotide
ccuugguccccagggagagcauugcaa

SEQ ID NO: 3366 - DNA, 27 bp, Artificial Sequence
  Synthetic oligonucleotide
ttgcaatgctctccctggggaccaagg

SEQ ID NO: 3367 - DNA, 25 bp, Artificial Sequence
  Synthetic oligonucleotide
ggggaccaaggcugacacucacgat

SEQ ID NO: 3368 - RNA, 27 nt, Artificial Sequence
  Synthetic oligonucleotide
aucgugagugucagccuugguccccag

SEQ ID NO: 3369 - DNA, 27 bp, Artificial Sequence
  Synthetic oligonucleotide
ctggggaccaaggctgacactcacgat

SEQ ID NO: 3370 - DNA, 25 bp, Artificial Sequence
  Synthetic oligonucleotide
uccuggagggccugaauuucaacct

SEQ ID NO: 3371 - RNA, 27 nt, Artificial Sequence
  Synthetic oligonucleotide
agguugaaauucaggcccuccaggauu

SEQ ID NO: 3372 - DNA, 27 bp, Artificial Sequence
  Synthetic oligonucleotide
aatcctggagggcctgaatttcaacct

SEQ ID NO: 3373 - DNA, 25 bp, Artificial Sequence
  Synthetic oligonucleotide
cagacagccagcuccagcugaccac

SEQ ID NO: 3374 - RNA, 27 nt, Artificial Sequence
  Synthetic oligonucleotide
guggucagcuggagcuggcugucuggc

SEQ ID NO: 3375 - DNA, 27 bp, Artificial Sequence
  Synthetic oligonucleotide
gccagacagccagctccagctgaccac

SEQ ID NO: 3376 - DNA, 25 bp, Artificial Sequence
  Synthetic oligonucleotide
aucuucuuuaaaggcaaaugggaga

SEQ ID NO: 3377 - RNA, 27 nt, Artificial Sequence
  Synthetic oligonucleotide
ucucccauuugccuuuaaagaagaugu

SEQ ID NO: 3378 - DNA, 27 bp, Artificial Sequence
  Synthetic oligonucleotide
acatcttctttaaaggcaaatgggaga

SEQ ID NO: 3379 - DNA, 25 bp, Artificial Sequence
  Synthetic oligonucleotide
uuaaaggcaaaugggagagaccctt

SEQ ID NO: 3380 - RNA, 27 nt, Artificial Sequence
  Synthetic oligonucleotide
aagggucucucccauuugccuuuaaag

SEQ ID NO: 3381 - DNA, 27 bp, Artificial Sequence
  Synthetic oligonucleotide
ctttaaaggcaaatgggagagaccctt

SEQ ID NO: 3382 - DNA, 25 bp, Artificial Sequence
  Synthetic oligonucleotide
uaaaggcaaaugggagagacccutt

SEQ ID NO: 3383 - RNA, 27 nt, Artificial Sequence
  Synthetic oligonucleotide
aaagggucucucccauuugccuuuaaa

SEQ ID NO: 3384 - DNA, 27 bp, Artificial Sequence
  Synthetic oligonucleotide
tttaaaggcaaatgggagagacccttt

SEQ ID NO: 3385 - DNA, 25 bp, Artificial Sequence
  Synthetic oligonucleotide
agaagcuguccagcugggugcugct

SEQ ID NO: 3386 - RNA, 27 nt, Artificial Sequence
  Synthetic oligonucleotide
agcagcacccagcuggacagcuucuua

SEQ ID NO: 3387 - DNA, 27 bp, Artificial Sequence
  Synthetic oligonucleotide
taagaagctgtccagctgggtgctgct

SEQ ID NO: 3388 - DNA, 25 bp, Artificial Sequence
  Synthetic oligonucleotide
augccaccgccaucuucuuccugcc

SEQ ID NO: 3389 - RNA, 27 nt, Artificial Sequence
  Synthetic oligonucleotide
ggcaggaagaagauggcgguggcauug

SEQ ID NO: 3390 - DNA, 27 bp, Artificial Sequence
  Synthetic oligonucleotide
caatgccaccgccatcttcttcctgcc

SEQ ID NO: 3391 - DNA, 25 bp, Artificial Sequence
  Synthetic oligonucleotide
gccaccgccaucuucuuccugcctg

SEQ ID NO: 3392 - RNA, 27 nt, Artificial Sequence
  Synthetic oligonucleotide
caggcaggaagaagauggcgguggcau

SEQ ID NO: 3393 - DNA, 27 bp, Artificial Sequence
  Synthetic oligonucleotide
atgccaccgccatcttcttcctgcctg

SEQ ID NO: 3394 - DNA, 25 bp, Artificial Sequence
  Synthetic oligonucleotide
aggaggcaccccugaagcucuccaa

SEQ ID NO: 3395 - RNA, 27 nt, Artificial Sequence
  Synthetic oligonucleotide
uuggagagcuucaggggugccuccucu

SEQ ID NO: 3396 - DNA, 27 bp, Artificial Sequence
  Synthetic oligonucleotide
agaggaggcacccctgaagctctccaa

SEQ ID NO: 3397 - DNA, 25 bp, Artificial Sequence
  Synthetic oligonucleotide
aaggccgugcauaaggcugugcuga

SEQ ID NO: 3398 - RNA, 27 nt, Artificial Sequence
  Synthetic oligonucleotide
ucagcacagccuuaugcacggccuugg

SEQ ID NO: 3399 - DNA, 27 bp, Artificial Sequence
  Synthetic oligonucleotide
ccaaggccgtgcataaggctgtgctga

SEQ ID NO: 3400 - DNA, 25 bp, Artificial Sequence
  Synthetic oligonucleotide
ccgugcauaaggcugugcugaccat

SEQ ID NO: 3401 - RNA, 27 nt, Artificial Sequence
  Synthetic oligonucleotide
auggucagcacagccuuaugcacggcc

SEQ ID NO: 3402 - DNA, 27 bp, Artificial Sequence
  Synthetic oligonucleotide
ggccgtgcataaggctgtgctgaccat

SEQ ID NO: 3403 - RNA, 25 nt, Artificial Sequence
  Synthetic oligonucleotide
ccccagggagaugcugcccagaaga

SEQ ID NO: 3404 - RNA, 25 nt, Artificial Sequence
  Synthetic oligonucleotide
gccuuugcaaugcucucccugggga

SEQ ID NO: 3405 - RNA, 25 nt, Artificial Sequence
  Synthetic oligonucleotide
gcaaugcucucccuggggaccaagg

SEQ ID NO: 3406 - RNA, 25 nt, Artificial Sequence
  Synthetic oligonucleotide
ggggaccaaggcugacacucacgau

SEQ ID NO: 3407 - RNA, 25 nt, Artificial Sequence
  Synthetic oligonucleotide
uccuggagggccugaauuucaaccu

SEQ ID NO: 3408 - RNA, 25 nt, Artificial Sequence
  Synthetic oligonucleotide
cagacagccagcuccagcugaccac

SEQ ID NO: 3409 - RNA, 25 nt, Artificial Sequence
  Synthetic oligonucleotide
aucuucuuuaaaggcaaaugggaga

SEQ ID NO: 3410 - RNA, 25 nt, Artificial Sequence
  Synthetic oligonucleotide
uuaaaggcaaaugggagagacccuu

SEQ ID NO: 3411 - RNA, 25 nt, Artificial Sequence
  Synthetic oligonucleotide
uaaaggcaaaugggagagacccuuu

SEQ ID NO: 3412 - RNA, 25 nt, Artificial Sequence
  Synthetic oligonucleotide
agaagcuguccagcugggugcugcu

SEQ ID NO: 3413 - RNA, 25 nt, Artificial Sequence
  Synthetic oligonucleotide
augccaccgccaucuucuuccugcc

SEQ ID NO: 3414 - RNA, 25 nt, Artificial Sequence
  Synthetic oligonucleotide
gccaccgccaucuucuuccugccug

SEQ ID NO: 3415 - RNA, 25 nt, Artificial Sequence
  Synthetic oligonucleotide
aggaggcaccccugaagcucuccaa

SEQ ID NO: 3416 - RNA, 25 nt, Artificial Sequence
  Synthetic oligonucleotide
aaggccgugcauaaggcugugcuga

SEQ ID NO: 3417 - RNA, 25 nt, Artificial Sequence
  Synthetic oligonucleotide
ccgugcauaaggcugugcugaccau

SEQ ID NO: 3418 - RNA, 21 nt, Artificial Sequence
  Synthetic oligonucleotide
auccccagggagaugcugccc

SEQ ID NO: 3419 - RNA, 21 nt, Artificial Sequence
  Synthetic oligonucleotide
cagccuuugcaaugcucuccc

SEQ ID NO: 3420 - RNA, 21 nt, Artificial Sequence
  Synthetic oligonucleotide
uugcaaugcucucccugggga

SEQ ID NO: 3421 - RNA, 21 nt, Artificial Sequence
  Synthetic oligonucleotide
cuggggaccaaggcugacacu

SEQ ID NO: 3422 - RNA, 21 nt, Artificial Sequence
  Synthetic oligonucleotide
aauccuggagggccugaauuu

SEQ ID NO: 3423 - RNA, 21 nt, Artificial Sequence
  Synthetic oligonucleotide
gccagacagccagcuccagcu

SEQ ID NO: 3424 - RNA, 21 nt, Artificial Sequence
  Synthetic oligonucleotide
acaucuucuuuaaaggcaaau

SEQ ID NO: 3425 - RNA, 21 nt, Artificial Sequence
  Synthetic oligonucleotide
cuuuaaaggcaaaugggagag

SEQ ID NO: 3426 - RNA, 21 nt, Artificial Sequence
  Synthetic oligonucleotide
uuuaaaggcaaaugggagaga

SEQ ID NO: 3427 - RNA, 21 nt, Artificial Sequence
  Synthetic oligonucleotide
uaagaagcuguccagcugggu

SEQ ID NO: 3428 - RNA, 21 nt, Artificial Sequence
  Synthetic oligonucleotide
caaugccaccgccaucuucuu

SEQ ID NO: 3429 - RNA, 21 nt, Artificial Sequence
  Synthetic oligonucleotide
augccaccgccaucuucuucc

SEQ ID NO: 3430 - RNA, 21 nt, Artificial Sequence
  Synthetic oligonucleotide
agaggaggcaccccugaagcu

SEQ ID NO: 3431 - RNA, 21 nt, Artificial Sequence
  Synthetic oligonucleotide
ccaaggccgugcauaaggcug

SEQ ID NO: 3432 - RNA, 21 nt, Artificial Sequence
  Synthetic oligonucleotide
ggccgugcauaaggcugugcu

SEQ ID NO: 3433 - RNA, 27 nt, Artificial Sequence
  Synthetic oligonucleotide
auccccagggagaugcugcccagaaga

SEQ ID NO: 3434 - RNA, 27 nt, Artificial Sequence
  Synthetic oligonucleotide
cagccuuugcaaugcucucccugggga

SEQ ID NO: 3435 - RNA, 27 nt, Artificial Sequence
  Synthetic oligonucleotide
uugcaaugcucucccuggggaccaagg

SEQ ID NO: 3436 - RNA, 27 nt, Artificial Sequence
  Synthetic oligonucleotide
cuggggaccaaggcugacacucacgau

SEQ ID NO: 3437 - RNA, 27 nt, Artificial Sequence
  Synthetic oligonucleotide
aauccuggagggccugaauuucaaccu

SEQ ID NO: 3438 - RNA, 27 nt, Artificial Sequence
  Synthetic oligonucleotide
gccagacagccagcuccagcugaccac

SEQ ID NO: 3439 - RNA, 27 nt, Artificial Sequence
  Synthetic oligonucleotide
acaucuucuuuaaaggcaaaugggaga

SEQ ID NO: 3440 - RNA, 27 nt, Artificial Sequence
  Synthetic oligonucleotide
cuuuaaaggcaaaugggagagacccuu

SEQ ID NO: 3441 - RNA, 27 nt, Artificial Sequence
  Synthetic oligonucleotide
uuuaaaggcaaaugggagagacccuuu

SEQ ID NO: 3442 - RNA, 27 nt, Artificial Sequence
  Synthetic oligonucleotide
uaagaagcuguccagcugggugcugcu

SEQ ID NO: 3443 - RNA, 27 nt, Artificial Sequence
  Synthetic oligonucleotide
caaugccaccgccaucuucuuccugcc

SEQ ID NO: 3444 - RNA, 27 nt, Artificial Sequence
  Synthetic oligonucleotide
augccaccgccaucuucuuccugccug

SEQ ID NO: 3445 - RNA, 27 nt, Artificial Sequence
  Synthetic oligonucleotide
agaggaggcaccccugaagcucuccaa

SEQ ID NO: 3446 - RNA, 27 nt, Artificial Sequence
  Synthetic oligonucleotide
ccaaggccgugcauaaggcugugcuga

SEQ ID NO: 3447 - RNA, 27 nt, Artificial Sequence
  Synthetic oligonucleotide
ggccgugcauaaggcugugcugaccau

SEQ ID NO: 3448 - RNA, 19 nt, Artificial Sequence
  Synthetic oligonucleotide
ccccagggagaugcugccc

SEQ ID NO: 3449 - RNA, 19 nt, Artificial Sequence
  Synthetic oligonucleotide
uccccagggagaugcugcc

SEQ ID NO: 3450 - RNA, 19 nt, Artificial Sequence
  Synthetic oligonucleotide
auccccagggagaugcugc

SEQ ID NO: 3451 - RNA, 19 nt, Artificial Sequence
  Synthetic oligonucleotide
gccuuugcaaugcucuccc

SEQ ID NO: 3452 - RNA, 19 nt, Artificial Sequence
  Synthetic oligonucleotide
agccuuugcaaugcucucc

SEQ ID NO: 3453 - RNA, 19 nt, Artificial Sequence
  Synthetic oligonucleotide
cagccuuugcaaugcucuc

SEQ ID NO: 3454 - RNA, 19 nt, Artificial Sequence
  Synthetic oligonucleotide
gcaaugcucucccugggga

SEQ ID NO: 3455 - RNA, 19 nt, Artificial Sequence
  Synthetic oligonucleotide
ugcaaugcucucccugggg

SEQ ID NO: 3456 - RNA, 19 nt, Artificial Sequence
  Synthetic oligonucleotide
uugcaaugcucucccuggg

SEQ ID NO: 3457 - RNA, 19 nt, Artificial Sequence
  Synthetic oligonucleotide
ggggaccaaggcugacacu

SEQ ID NO: 3458 - RNA, 19 nt, Artificial Sequence
  Synthetic oligonucleotide
uggggaccaaggcugacac

SEQ ID NO: 3459 - RNA, 19 nt, Artificial Sequence
  Synthetic oligonucleotide
cuggggaccaaggcugaca

SEQ ID NO: 3460 - RNA, 19 nt, Artificial Sequence
  Synthetic oligonucleotide
uccuggagggccugaauuu

SEQ ID NO: 3461 - RNA, 19 nt, Artificial Sequence
  Synthetic oligonucleotide
auccuggagggccugaauu

SEQ ID NO: 3462 - RNA, 19 nt, Artificial Sequence
  Synthetic oligonucleotide
aauccuggagggccugaau

SEQ ID NO: 3463 - RNA, 19 nt, Artificial Sequence
  Synthetic oligonucleotide
cagacagccagcuccagcu

SEQ ID NO: 3464 - RNA, 19 nt, Artificial Sequence
  Synthetic oligonucleotide
ccagacagccagcuccagc

SEQ ID NO: 3465 - RNA, 19 nt, Artificial Sequence
  Synthetic oligonucleotide
gccagacagccagcuccag

SEQ ID NO: 3466 - RNA, 19 nt, Artificial Sequence
  Synthetic oligonucleotide
aucuucuuuaaaggcaaau

SEQ ID NO: 3467 - RNA, 19 nt, Artificial Sequence
  Synthetic oligonucleotide
caucuucuuuaaaggcaaa

SEQ ID NO: 3468 - RNA, 19 nt, Artificial Sequence
  Synthetic oligonucleotide
acaucuucuuuaaaggcaa

SEQ ID NO: 3469 - RNA, 19 nt, Artificial Sequence
  Synthetic oligonucleotide
uuaaaggcaaaugggagag

SEQ ID NO: 3470 - RNA, 19 nt, Artificial Sequence
  Synthetic oligonucleotide
uuuaaaggcaaaugggaga

SEQ ID NO: 3471 - RNA, 19 nt, Artificial Sequence
  Synthetic oligonucleotide
cuuuaaaggcaaaugggag

SEQ ID NO: 3472 - RNA, 19 nt, Artificial Sequence
  Synthetic oligonucleotide
uaaaggcaaaugggagaga

SEQ ID NO: 3473 - RNA, 19 nt, Artificial Sequence
  Synthetic oligonucleotide
uuaaaggcaaaugggagag

SEQ ID NO: 3474 - RNA, 19 nt, Artificial Sequence
  Synthetic oligonucleotide
uuuaaaggcaaaugggaga

SEQ ID NO: 3475 - RNA, 19 nt, Artificial Sequence
  Synthetic oligonucleotide
agaagcuguccagcugggu

SEQ ID NO: 3476 - RNA, 19 nt, Artificial Sequence
  Synthetic oligonucleotide
aagaagcuguccagcuggg

SEQ ID NO: 3477 - RNA, 19 nt, Artificial Sequence
  Synthetic oligonucleotide
uaagaagcuguccagcugg

SEQ ID NO: 3478 - RNA, 19 nt, Artificial Sequence
  Synthetic oligonucleotide
augccaccgccaucuucuu

SEQ ID NO: 3479 - RNA, 19 nt, Artificial Sequence
  Synthetic oligonucleotide
aaugccaccgccaucuucu

SEQ ID NO: 3480 - RNA, 19 nt, Artificial Sequence
  Synthetic oligonucleotide
caaugccaccgccaucuuc

SEQ ID NO: 3481 - RNA, 19 nt, Artificial Sequence
  Synthetic oligonucleotide
gccaccgccaucuucuucc

SEQ ID NO: 3482 - RNA, 19 nt, Artificial Sequence
  Synthetic oligonucleotide
ugccaccgccaucuucuuc

SEQ ID NO: 3483 - RNA, 19 nt, Artificial Sequence
  Synthetic oligonucleotide
augccaccgccaucuucuu

SEQ ID NO: 3484 - RNA, 19 nt, Artificial Sequence
  Synthetic oligonucleotide
aggaggcaccccugaagcu

SEQ ID NO: 3485 - RNA, 19 nt, Artificial Sequence
  Synthetic oligonucleotide
gaggaggcaccccugaagc

SEQ ID NO: 3486 - RNA, 19 nt, Artificial Sequence
  Synthetic oligonucleotide
agaggaggcaccccugaag

SEQ ID NO: 3487 - RNA, 19 nt, Artificial Sequence
  Synthetic oligonucleotide
aaggccgugcauaaggcug

SEQ ID NO: 3488 - RNA, 19 nt, Artificial Sequence
  Synthetic oligonucleotide
caaggccgugcauaaggcu

SEQ ID NO: 3489 - RNA, 19 nt, Artificial Sequence
  Synthetic oligonucleotide
ccaaggccgugcauaaggc

SEQ ID NO: 3490 - RNA, 19 nt, Artificial Sequence
  Synthetic oligonucleotide
ccgugcauaaggcugugcu

SEQ ID NO: 3491 - RNA, 19 nt, Artificial Sequence
  Synthetic oligonucleotide
gccgugcauaaggcugugc

SEQ ID NO: 3492 - RNA, 19 nt, Artificial Sequence
  Synthetic oligonucleotide
ggccgugcauaaggcugug

SEQ ID NO: 3493 - DNA, 37 bp, Artificial Sequence
  Synthetic oligonucleotide
tgcuaucgauagaagaagauauuggugcuguuggacu

SEQ ID NO: 3494 - DNA, 37 bp, Artificial Sequence
  Synthetic oligonucleotide
tgcuaucgauaagauguaauucaccagagcaaaaacu

SEQ ID NO: 3495 - DNA, 37 bp, Artificial Sequence
  Synthetic oligonucleotide
tgcuaucgauuucucgucgauggucagcacagccuua

SEQ ID NO: 3496 - DNA, 37 bp, Artificial Sequence
  Synthetic oligonucleotide
tgcuaucgauguucaaucauuaagaagacaaaggguu

SEQ ID NO: 3497 - DNA, 37 bp, Artificial Sequence
  Synthetic oligonucleotide
tgcuaucgauuguucaaucauuaagaagacaaagggu

SEQ ID NO: 3498 - DNA, 37 bp, Artificial Sequence
  Synthetic oligonucleotide
tgcuaucgauugguauuuuguucaaucauuaagaaga

SEQ ID NO: 3499 - DNA, 37 bp, Artificial Sequence
  Synthetic oligonucleotide
tgcuaucgaugagacuugguauuuuguucaaucauua

We claim:

1. A modified nucleic acid comprising an oligonucleotide strand of 19-53 nucleotides in length, wherein said oligonucleotide strand is complementary to SEQ ID NO: 1080 along at least 19 consecutive nucleotides of said oligonucleotide strand length and reduces α-1 antitrypsin target mRNA expression when said nucleic acid is introduced into a mammalian cell.

2. A double stranded nucleic acid (dsNA) comprising first and second nucleic acid strands comprising RNA, wherein said first strand is 15-53 nucleotides in length and said second strand of said dsNA is 19-53 nucleotides in length, wherein said second oligonucleotide strand is complementary to SEQ ID NO: 1080 along at least 19 consecutive nucleotides of said second oligonucleotide strand length and reduces α-1 antitrypsin target mRNA expression when said double stranded nucleic acid is introduced into a mammalian cell.

3. The dsNA of claim 2 comprising a duplex region selected from the group consisting of at least 25 base pairs; 19-21 base pairs and 21-25 base pairs.

4. The dsNA of claim 2, wherein said second oligonucleotide strand comprises 1-5 single-stranded nucleotides at its 3' terminus.

5. The dsNA of claim 4, wherein said 1-5 single-stranded nucleotides of said 3' terminus of said second strand are 1-3 nucleotides in length.

6. The dsNA of claim 4, wherein said 1-5 single-stranded nucleotides of said 3' terminus of said second strand are 1-2 nucleotides in length.

7. The dsNA of claim 4, wherein said nucleotides of said 1-5 single-stranded nucleotides of said 3' terminus of said second strand comprise a modified nucleotide.

8. The dsNA of claim 7, wherein said modified nucleotide of said 1-5 single-stranded nucleotides of said 3' terminus of said second strand is a 2'-O-methyl ribonucleotide.

9. The dsNA of claim 7, wherein all nucleotides of said 1-5 single-stranded nucleotides of said 3' terminus of said second strand are modified nucleotides.

10. The dsNA of claim 7, wherein said 1-5 single-stranded nucleotides of said 3' terminus of said second strand is two nucleotides in length and comprises a 2'-O-methyl modified ribonucleotide.

11. The dsNA of claim 2, wherein said first strand is 25-53 nucleotides in length.

12. The dsNA of claim 2, wherein said second strand is 25-53 nucleotides in length.

13. The dsNA of claim 2, wherein starting from the first nucleotide (position 1) at the 3' terminus of the first oligonucleotide strand, position 1, 2 and/or 3 is substituted with a modified nucleotide.

14. The dsNA of claim 13, wherein said modified nucleotide residue of said 3' terminus of said first strand is selected from the group consisting of a deoxyribonucleotide, an acyclonucleotide and a fluorescent molecule.

15. The dsNA of claim 14, wherein position 1 of said 3' terminus of the first oligonucleotide strand is a deoxyribonucleotide.

16. The dsNA of claim 2, wherein 3' terminus of said first strand and 5' terminus of said second strand form a blunt end.

17. The dsNA of claim 2, wherein said first strand is 25 nucleotides in length and said second strand is 27 nucleotides in length.

18. The dsNA of claim 2, wherein said second strand comprises SEQ ID NO: 288.

19. The dsNA of claim 2, wherein said first strand comprises SEQ ID NO: 90.

20. The dsNA of claim 2 comprising a pair of first strand/second strand sequences of SEQ ID NO: 90 and SEQ ID NO: 288.

21. The dsNA of claim 2, wherein said dsNA comprises a modified nucleotide.

22. The dsNA of claim 2, wherein the first and second strands are joined by a chemical linker.

23. The dsNA of claim 2, wherein 3' terminus of said first strand and 5' terminus of said second strand are joined by a chemical linker.

24. The dsNA of claim 2, wherein a nucleotide of said second or first strand is substituted with a modified nucleotide that directs the orientation of Dicer cleavage.

25. The dsNA of claim 2 comprising a modified nucleotide selected from the group consisting of a 2'-O-methyl ribonucleotide, a 2'-methoxyethoxy, a 2'-fluoro ribonucleotide, a 2'-allyl, a 2'-O-[2-(methylamino)-2-oxoethyl], a 4'-thio, a 4'-CH$_2$—O-2'-bridge, a 4'-(CH$_2$)$_2$—O-2'-bridge, a 2'-LNA, a 2'-amino, a 2'-O-(N-methlycarbamate), a deoxyribonucleotide, a dideoxyribonucleotide, an acyclonucleotide, a 3'-deoxyadenosine (cordycepin), a 3'-azido-3'-deoxythymidine (AZT), a 2',3'-dideoxyinosine (ddI), a 2',3'-dideoxy-3'-thiacytidine (3TC), a 2',3'-didehydro-2',3'-dideoxythymidine (d4T), a monophosphate nucleotide of 3'-azido-3'-deoxythymidine (AZT), a 2',3'-dideoxy-3'-thiacytidine (3TC), a monophosphate nucleotide of 2',3'-didehydro-2',3'-dideoxythymidine (d4T), a 4-thiouracil, a 5-bromouracil, a 5-iodouracil, a 5-(3-aminoallyl)-uracil, a 2'-O-alkyl ribonucleotide, a 2'-amino ribonucleotide, a locked nucleic acid and an unlocked nucleobase analog (UNA).

26. The dsNA of claim 2 comprising a phosphate backbone modification selected from the group consisting of a phosphonate, a phosphorothioate and a phosphotriester.

27. The dsNA of claim 2 comprising a modification selected from the group consisting of a morpholino nucleic acid and a peptide nucleic acid (PNA).

28. The dsNA of claim 2, wherein said dsNA is attached to a dynamic polyconjugate (DPC).

29. Composition comprising the dsNA of claim 2, wherein said dsNA is administered with a DPC, where the dsNA and DPC are optionally not attached.

30. The dsNA of claim 2, wherein said dsNA is attached to a moiety selected from the group consisting of a GalNAc moiety, a cholesterol and a cholesterol targeting ligand.

31. A method for reducing expression of a target α-1 antitrypsin gene in a mammalian cell comprising contacting a mammalian cell in vitro with a dsNA of claim 2 in an amount sufficient to reduce expression of a target α-1 antitrypsin mRNA in said cell.

32. The method of claim 31, wherein target α-1 antitrypsin mRNA expression is reduced by an amount (expressed by %) selected from the group consisting of at least 10%, at least 50% and at least 80-90%.

33. The method of claim 31, wherein α-1 antitrypsin mRNA levels are reduced by an amount (expressed by %) of at least 90% at least 8 days after said cell is contacted with said dsNA.

34. The method of claim 31, wherein α-1 antitrypsin mRNA levels are reduced by an amount (expressed by %) of at least 70% at least 10 days after said cell is contacted with said dsNA.

35. A method for reducing expression of a target α-1 antitrypsin mRNA in a mammal comprising administering a nucleic acid of claim 1 to a mammal in an amount sufficient to reduce expression of a target α-1 antitrypsin mRNA in the mammal.

36. The method of claim 35, wherein said nucleic acid is formulated in a lipid nanoparticle (LNP).

37. The method of claim 35, wherein said nucleic acid is administered at a dosage selected from the group consisting of 1 microgram to 5 milligrams per kilogram of said mammal per day, 100 micrograms to 0.5 milligrams per kilogram, 0.001 to 0.25 milligrams per kilogram, 0.01 to 20 micrograms per kilogram, 0.01 to 10 micrograms per kilogram, 0.10 to 5 micrograms per kilogram, and 0.1 to 2.5 micrograms per kilogram.

38. The method of claim 35, wherein α-1 antitrypsin mRNA levels are reduced in a tissue of said mammal by an amount (expressed by %) of at least 70% at least 3 days after said dsNA is administered to said mammal.

39. The method of claim 38, wherein said tissue is liver tissue.

40. The method of claim 35, wherein said administering step comprises a mode selected from the group consisting of intravenous injection, intramuscular injection, intraperitoneal injection, infusion, subcutaneous injection, transdermal, aerosol, rectal, vaginal, topical, oral and inhaled delivery.

41. A method for treating or preventing a liver disease or disorder in a subject comprising administering to said subject an amount of a nucleic acid of claim 1 sufficient to treat or prevent said liver disease or disorder in said subject, wherein said liver disease or disorder is selected from the group consisting of chronic liver disease, liver inflammation, cirrhosis, liver fibrosis and hepatocellular carcinoma.

42. The method of claim 41, wherein said subject is human.

43. A formulation comprising the nucleic acid of claim 1, wherein said nucleic acid is present in an amount effective to reduce target α-1 antitrypsin mRNA levels when said nucleic acid is introduced into a mammalian cell in vitro by an amount (expressed by %) selected from the group consisting of at least 10%, at least 50% and at least 80-90%.

44. The formulation of claim 43, wherein said effective amount is selected from the group consisting of 1 nanomolar or less, 200 picomolar or less, 100 picomolar or less, 50 picomolar or less, 20 picomolar or less, 10 picomolar or less, 5 picomolar or less, 2, picomolar or less and 1 picomolar or less in the environment of said cell.

45. A formulation comprising the dsNA of claim 2, wherein said dsNA is present in an amount effective to reduce target α-1 antitrypsin mRNA levels when said dsNA is introduced into a cell of a mammalian subject by an amount (expressed by %) selected from the group consisting of at least 10%, at least 50% and at least 80-90%.

46. The formulation of claim 45, wherein said effective amount is a dosage selected from the group consisting of 1 microgram to 5 milligrams per kilogram of said subject per day, 100 micrograms to 0.5 milligrams per kilogram, 0.001 to 0.25 milligrams per kilogram, 0.01 to 20 micrograms per kilogram, 0.01 to 10 micrograms per kilogram, 0.10 to 5 micrograms per kilogram, and 0.1 to 2.5 micrograms per kilogram.

47. A mammalian cell containing the nucleic acid of claim 1.

48. A pharmaceutical composition comprising the nucleic acid of claim 1 and a pharmaceutically acceptable carrier.

49. A kit comprising the nucleic acid of claim 1 and instructions for its use.

50. A composition possessing α-1 antitrypsin inhibitory activity consisting essentially of a nucleic acid of claim 1.

51. The dsNA of claim 2, wherein said second oligonucleotide strand comprises a modification pattern selected from the following:

```
AS-M1     3'-XXXXXXXXXXXXXXXXXXXXXXXXXX-5'
AS-M2     3'-XXXXXXXXXXXXXXXXXXXXXXXXXX-5'
AS-M3     3'-XXXXXXXXXXXXXXXXXXXXXXXXXX-5'
AS-M4     3'-XXXXXXXXXXXXXXXXXXXXXXXXXX-5'
AS-M5     3'-XXXXXXXXXXXXXXXXXXXXXXXXXX-5'
AS-M6     3'-XXXXXXXXXXXXXXXXXXXXXXXXXX-5'
AS-M7     3'-XXXXXXXXXXXXXXXXXXXXXXXXXX-5'
AS-M8     3'-XXXXXXXXXXXXXXXXXXXXXXXXXX-5'
AS-M9     3'-XXXXXXXXXXXXXXXXXXXXXXXXXX-5'
AS-M10    3'-XXXXXXXXXXXXXXXXXXXXXXXXXX-5'
AS-M11    3'-XXXXXXXXXXXXXXXXXXXXXXXXXX-5'
AS-M12    3'-XXXXXXXXXXXXXXXXXXXXXXXXXX-5'
AS-M13    3'-XXXXXXXXXXXXXXXXXXXXXXXXXX-5'
AS-M14    3'-XXXXXXXXXXXXXXXXXXXXXXXXXX-5'
AS-M15    3'-XXXXXXXXXXXXXXXXXXXXXXXXXX-5'
AS-M16    3'-XXXXXXXXXXXXXXXXXXXXXXXXXX-5'
AS-M17    3'-XXXXXXXXXXXXXXXXXXXXXXXXXX-5'
AS-M18    3'-XXXXXXXXXXXXXXXXXXXXXXXXXX-5'
AS-M19    3'-XXXXXXXXXXXXXXXXXXXXXXXXXX-5'
AS-M20    3'-XXXXXXXXXXXXXXXXXXXXXXXXXX-5'
AS-M21    3'-XXXXXXXXXXXXXXXXXXXXXXXXXX-5'
AS-M22    3'-XXXXXXXXXXXXXXXXXXXXXXXXXX-5'
AS-M24    3'-XXXXXXXXXXXXXXXXXXXXXXXXXX-5'
AS-M25    3'-XXXXXXXXXXXXXXXXXXXXXXXXXX-5'
AS-M26    3'-XXXXXXXXXXXXXXXXXXXXXXXXXX-5'
AS-M27    3'-XXXXXXXXXXXXXXXXXXXXXXXXXX-5'
AS-M28    3'-XXXXXXXXXXXXXXXXXXXXXXXXXX-5'
AS-M29    3'-XXXXXXXXXXXXXXXXXXXXXXXXXX-5'
AS-M30    3'-XXXXXXXXXXXXXXXXXXXXXXXXXX-5'
AS-M31    3'-XXXXXXXXXXXXXXXXXXXXXXXXXX-5'
AS-M32    3'-XXXXXXXXXXXXXXXXXXXXXXXXXX-5'
AS-M34    3'-XXXXXXXXXXXXXXXXXXXXXXXXXX-5'
AS-M35    3'-XXXXXXXXXXXXXXXXXXXXXXXXXX-5'
AS-M36    3'-XXXXXXXXXXXXXXXXXXXXXXXXXX-5'
AS-M37    3'-XXXXXXXXXXXXXXXXXXXXXXXXXX-5'
AS-M38    3'-XXXXXXXXXXXXXXXXXXXXXXXXXX-5'
AS-M40    3'-XXXXXXXXXXXXXXXXXXXXXXXXXX-5'
AS-M41    3'-XXXXXXXXXXXXXXXXXXXXXXXXXX-5'
AS-M42    3'-XXXXXXXXXXXXXXXXXXXXXXXXXX-5'
AS-M43    3'-XXXXXXXXXXXXXXXXXXXXXXXXXX-5'
AS-M44    3'-XXXXXXXXXXXXXXXXXXXXXXXXXX-5'
AS-M45    3'-XXXXXXXXXXXXXXXXXXXXXXXXXX-5'
AS-M46    3'-XXXXXXXXXXXXXXXXXXXXXXXXXX-5'
```

```
AS-M47       3'-XXXXXXXXXXXXXXXXXXXXXXXXX-5'
AS-M48       3'-XXXXXXXXXXXXXXXXXXXXXXXX-5'
AS-M52       3'-XXXXXXXXXXXXXXXXXXXXXXXXX-5'
AS-M54       3'-XXXXXXXXXXXXXXXXXXXXXXXXX-5'
AS-M55       3'-XXXXXXXXXXXXXXXXXXXXXXXXX-5'
AS-M56       3'-XXXXXXXXXXXXXXXXXXXXXXXXX-5'
AS-M57       3'-XXXXXXXXXXXXXXXXXXXXXXXXX-5'
AS-M58       3'-XXXXXXXXXXXXXXXXXXXXXXXXX-5'
AS-M59       3'-XXXXXXXXXXXXXXXXXXXXXXXXX-5'
AS-M60       3'-XXXXXXXXXXXXXXXXXXXXXXXXX-5'
AS-M61       3'-XXXXXXXXXXXXXXXXXXXXXXXXX-5'
AS-M62       3'-XXXXXXXXXXXXXXXXXXXXXXXXX-5'
AS-M63       3'-XXXXXXXXXXXXXXXXXXXXXXXXX-5'
AS-M64       3'-XXXXXXXXXXXXXXXXXXXXXXXXX-5'
AS-M65       3'-XXXXXXXXXXXXXXXXXXXXXXXXX-5'
AS-M66       3'-XXXXXXXXXXXXXXXXXXXXXXXXX-5'
AS-M67       3'-XXXXXXXXXXXXXXXXXXXXXXXXX-5'
AS-M68       3'-XXXXXXXXXXXXXXXXXXXXXXXXX-5'
AS-M69       3'-XXXXXXXXXXXXXXXXXXXXXXXXX-5'
AS-M70       3'-XXXXXXXXXXXXXXXXXXXXXXXXX-5'
AS-M71       3'-XXXXXXXXXXXXXXXXXXXXXXXXX-5'
AS-M72       3'-XXXXXXXXXXXXXXXXXXXXXXXXX-5'
AS-M73       3'-XXXXXXXXXXXXXXXXXXXXXXXXX-5'
AS-M74       3'-XXXXXXXXXXXXXXXXXXXXXXXXX-5'
AS-M75       3'-XXXXXXXXXXXXXXXXXXXXXXXXX-5'
AS-M76       3'-XXXXXXXXXXXXXXXXXXXXXXXXX-5'
AS-M77       3'-XXXXXXXXXXXXXXXXXXXXXXXXX-5'
AS-M78       3'-XXXXXXXXXXXXXXXXXXXXXXXXX-5'
AS-M79       3'-XXXXXXXXXXXXXXXXXXXXXXXXX-5'
AS-M80       3'-XXXXXXXXXXXXXXXXXXXXXXXXX-5'
AS-M81       3'-XXXXXXXXXXXXXXXXXXXXXXXXX-5'
AS-M82       3'-XpXXXXXXXXXXXXXXXXXXXXXXXXX-5'
AS-M83       3'-XpXXXXXXXXXXXXXXXXXXXXXXXXXX-5'
AS-M84       3'-XXXXXXXXXXXXXXXXXXXXXXXXX-5'
AS-M85       3'-XXXXXXXXXXXXXXXXXXXXXXXXX-5'
AS-M88       3'-FFFXXXXXXXXXXXXXXXXXFFFF-5'
AS-M89       3'-XXXXFXXXFXFXXXXXXXXXXXXX-5'
AS-M90       3'-FFFXFXFXFXFXFXFXFXXXXXFFFF-5'
AS-M91       3'-FFFXXXXXXXXXXXXXXXXXXXFF-5'
AS-M92       3'-XXXXXXXXXXXXFXFXXXXXXXXX-5'
AS-M93       3'-FFFXFXXXXXXXXXXXFXXXXXXX-5'
AS-M94       3'-FFFXFXFXXXXXXFXFXFXXXXFFFF-5'
AS-M95       3'-FFFXFXFXFXFXFXFXXXXXXFFFF-5'
AS-M96       3'-FFFXFXFXFXFXFXFXFXXXXXFFFpF-5'
AS-M210      3'-XXXXXXXXXXXXXXXXXXXXXXXX-5'
AS-M1*       3'-XXXXXXXXXXXXXXXXXXXXXXXXX-5'
AS-M2*       3'-XXXXXXXXXXXXXXXXXXXXXXXXX-5'
AS-M3*       3'-XXXXXXXXXXXXXXXXXXXXXXXXX-5'
AS-M4*       3'-XXXXXXXXXXXXXXXXXXXXXXXXX-5'
AS-M5*       3'-XXXXXXXXXXXXXXXXXXXXXXXXX-5'
AS-M6*       3'-XXXXXXXXXXXXXXXXXXXXXXXXX-5'
AS-M7*       3'-XXXXXXXXXXXXXXXXXXXXXXXXX-5'
AS-M8*       3'-XXXXXXXXXXXXXXXXXXXXXXXXX-5'
AS-M9*       3'-XXXXXXXXXXXXXXXXXXXXXXXXX-5'
AS-M10*      3'-XXXXXXXXXXXXXXXXXXXXXXXXX-5'
AS-M11*      3'-XXXXXXXXXXXXXXXXXXXXXXXXX-5'
AS-M12*      3'-XXXXXXXXXXXXXXXXXXXXXXXXX-5'
AS-M13*      3'-XXXXXXXXXXXXXXXXXXXXXXXXX-5'
AS-M14*      3'-XXXXXXXXXXXXXXXXXXXXXXXXX-5'
AS-M15*      3'-XXXXXXXXXXXXXXXXXXXXXXXXX-5'
AS-M16*      3'-XXXXXXXXXXXXXXXXXXXXXXXXX-5'
AS-M17*      3'-XXXXXXXXXXXXXXXXXXXXXXXXX-5'
AS-M18*      3'-XXXXXXXXXXXXXXXXXXXXXXXXX-5'
AS-M19*      3'-XXXXXXXXXXXXXXXXXXXXXXXXX-5'
AS-M20*      3'-XXXXXXXXXXXXXXXXXXXXXXXXX-5'
AS-M21*      3'-XXXXXXXXXXXXXXXXXXXXXXXXX-5'
AS-M22*      3'-XXXXXXXXXXXXXXXXXXXXXXXXX-5'
AS-M24*      3'-XXXXXXXXXXXXXXXXXXXXXXXXX-5'
AS-M25*      3'-XXXXXXXXXXXXXXXXXXXXXXXXX-5'
AS-M26*      3'-XXXXXXXXXXXXXXXXXXXXXXXXX-5'
AS-M27*      3'-XXXXXXXXXXXXXXXXXXXXXXXXX-5'
AS-M28*      3'-XXXXXXXXXXXXXXXXXXXXXXXXX-5'
AS-M29*      3'-XXXXXXXXXXXXXXXXXXXXXXXXX-5'
AS-M30*      3'-XXXXXXXXXXXXXXXXXXXXXXXXX-5'
AS-M31*      3'-XXXXXXXXXXXXXXXXXXXXXXXXX-5'
AS-M32*      3'-XXXXXXXXXXXXXXXXXXXXXXXXX-5'
AS-M34*      3'-XXXXXXXXXXXXXXXXXXXXXXXXX-5'
AS-M35*      3'-XXXXXXXXXXXXXXXXXXXXXXXXX-5'
AS-M36*      3'-XXXXXXXXXXXXXXXXXXXXXXXXX-5'
AS-M37*      3'-XXXXXXXXXXXXXXXXXXXXXXXXX-5'
AS-M38*      3'-XXXXXXXXXXXXXXXXXXXXXXXXX-5'
AS-M40*      3'-XXXXXXXXXXXXXXXXXXXXXXXXX-5'
AS-M41*      3'-XXXXXXXXXXXXXXXXXXXXXXXXX-5'
AS-M42*      3'-XXXXXXXXXXXXXXXXXXXXXXXXX-5'
AS-M43*      3'-XXXXXXXXXXXXXXXXXXXXXXXXX-5'
AS-M44*      3'-XXXXXXXXXXXXXXXXXXXXXXXXX-5'
AS-M45*      3'-XXXXXXXXXXXXXXXXXXXXXXXXX-5'
AS-M46*      3'-XXXXXXXXXXXXXXXXXXXXXXXXX-5'
AS-M47*      3'-XXXXXXXXXXXXXXXXXXXXXXXXX-5'
AS-M48*      3'-XXXXXXXXXXXXXXXXXXXXXXXXX-5'
AS-M52*      3'-XXXXXXXXXXXXXXXXXXXXXXXXX-5'
AS-M54*      3'-XXXXXXXXXXXXXXXXXXXXXXXXX-5'
AS-M55*      3'-XXXXXXXXXXXXXXXXXXXXXXXXX-5'
AS-M56*      3'-XXXXXXXXXXXXXXXXXXXXXXXXX-5'
AS-M57*      3'-XXXXXXXXXXXXXXXXXXXXXXXXX-5'
AS-M58*      3'-XXXXXXXXXXXXXXXXXXXXXXXXX-5'
AS-M59*      3'-XXXXXXXXXXXXXXXXXXXXXXXXX-5'
AS-M60*      3'-XXXXXXXXXXXXXXXXXXXXXXXXX-5'
AS-M61*      3'-XXXXXXXXXXXXXXXXXXXXXXXXX-5'
AS-M62*      3'-XXXXXXXXXXXXXXXXXXXXXXXXX-5'
AS-M63*      3'-XXXXXXXXXXXXXXXXXXXXXXXXX-5'
AS-M64*      3'-XXXXXXXXXXXXXXXXXXXXXXXXX-5'
AS-M65*      3'-XXXXXXXXXXXXXXXXXXXXXXXXX-5'
AS-M66*      3'-XXXXXXXXXXXXXXXXXXXXXXXXX-5'
AS-M67*      3'-XXXXXXXXXXXXXXXXXXXXXXXXX-5'
AS-M68*      3'-XXXXXXXXXXXXXXXXXXXXXXXXX-5'
AS-M69*      3'-XXXXXXXXXXXXXXXXXXXXXXXXX-5'
AS-M70*      3'-XXXXXXXXXXXXXXXXXXXXXXXXX-5'
AS-M71*      3'-XXXXXXXXXXXXXXXXXXXXXXXXX-5'
AS-M72*      3'-XXXXXXXXXXXXXXXXXXXXXXXXX-5'
AS-M73*      3'-XXXXXXXXXXXXXXXXXXXXXXXXX-5'
AS-M74*      3'-XXXXXXXXXXXXXXXXXXXXXXXXX-5'
AS-M75*      3'-XXXXXXXXXXXXXXXXXXXXXXXXX-5'
AS-M76*      3'-XXXXXXXXXXXXXXXXXXXXXXXXX-5'
AS-M77*      3'-XXXXXXXXXXXXXXXXXXXXXXXXX-5'
AS-M78*      3'-XXXXXXXXXXXXXXXXXXXXXXXXX-5'
AS-M79*      3'-XXXXXXXXXXXXXXXXXXXXXXXXX-5'
AS-M80*      3'-XXXXXXXXXXXXXXXXXXXXXXXXX-5'
AS-M81*      3'-XXXXXXXXXXXXXXXXXXXXXXXXX-5'
AS-M82*      3'-XpXXXXXXXXXXXXXXXXXXXXXXXXX-5'
AS-M83*      3'-XpXXXXXXXXXXXXXXXXXXXXXXXXXX-5'
AS-M84*      3'-XXXXXXXXXXXXXXXXXXXXXXXXX-5'
AS-M85*      3'-XXXXXXXXXXXXXXXXXXXXXXXXX-5'
AS-M88*      3'-XFFXXXXXXXXXXXXXXXXXXXFFFF-5'
AS-M89*      3'-XXXXFXXXFXFXXXXXXXXXXXXX-5'
AS-M90*      3'-XFFXFXFXFXFXFXFXFXXXXXFFFF-5'
AS-M91*      3'-XFFXXXXXXXXXXXXXXXXXXXFF-5'
AS-M92*      3'-XXXXXXXXXXXXFXFXXXXXXXXX-5'
AS-M93*      3'-XFFXFXXXXXXXXXXXFXXXXXXX-5'
AS-M94*      3'-XFFXFXFXXXXXXFXFXFXXXXFFFF-5'
AS-M95*      3'-XFFXFXFXFXFXFXFXXXXXXFFFF-5'
AS-M96*      3'-XFFXFXFXFXFXFXFXFXXXXXFFFpF-5'
AS-M210*     3'-XXXXXXXXXXXXXXXXXXXXXXXX-5'
``` wherein "X"=RNA, "X"=2'-O-methyl RNA, "F"=2'-Fluoro NA and "p"=Phosphorothioate linkage.

52. The dsNA of claim 2, wherein said first oligonucleotide strand comprises a modification pattern selected from the following:

```
"SM1"    5'-XXXXXXXXXXXXXXXXXXXXXXDD-3'
"SM2"    5'-XXXXXXXXXXXXXXXXXXXXXDD-3'
"SM3"    5'-XXXXXXXXXXXXXXXXXXXXXXDD-3'
"SM4"    5'-XXXXXXXXXXXXXXXXXXXXXXDD-3'
"SM5"    5'-XXXXXXXXXXXXXXXXXXXXXXDD-3'
"SM6"    5'-XXXXXXXXXXXXXXXXXXXXXXDD-3'
"SM7"    5'-XXXXXXXXXXXXXXXXXXXXXXDD-3'
"SM8"    5'-XXXXXXXXXXXXXXXXXXXXXXDD-3'
"SM9"    5'-XXXXXXXXXXXXXXXXXXXXXXDD-3'
"SM10"   5'-XXXXXXXXXXXXXXXXXXXXXXDD-3'
"SM11"   5'-XXXXXXXXXXXXXXXXXXXXXXDD-3'
"SM12"   5'-XXXXXXXXXXXXXXXXXXXXXXDD-3'
"SM13"   5'-XXXXXXXXXXXXXXXXXXXXXXDD-3'
"SM14"   5'-XXXXXXXXXXXXXXXXXXXXXXDD-3'
"SM15"   5'-XXXXXXXXXXXXXXXXXXXXXXDD-3'
"SM16"   5'-XXXXXXXXXXXXXXXXXXXXXXDD-3'
"SM17"   5'-XXXXXXXXXXXXXXXXXXXXXXDD-3'
"SM18"   5'-XXXXXXXXXXXXXXXXXXXXXXDD-3'
"SM19"   5'-XXXXXXXXXXXXXXXXXXXXXXDD-3'
```

```
"SM20"   5'-XXXXXXXXXXXXXXXXXXXXXXXXDD-3'
"SM21"   5'-XXXXXXXXXXXXXXXXXXXXXXXXDD-3'
"SM23"   5'-XXXXXXXXXXXXXXXXXXXXXXXXDD-3'
"SM24"   5'-XXXXXXXXXXXXXXXXXXXXXXXXDD-3'
"SM25"   5'-XXXXXXXXXXXXXXXXXXXXXXXXDD-3'
"SM30"   5'-XXXXXXXXXXXXXXXXXXXXXXXXDD-3'
"SM31"   5'-XXXXXXXXXXXXXXXXXXXXXXXXDD-3'
"SM32"   5'-XXXXXXXXXXXXXXXXXXXXXXXXDD-3'
"SM33"   5'-XXXXXXXXXXXXXXXXXXXXXXXXDD-3'
"SM34"   5'-XXXXXXXXXXXXXXXXXXXXXXXXDD-3'
"SM35"   5'-XXXXXXXXXXXXXXXXXXXXXXXXDD-3'
"SM36"   5'-XXXXXXXXXXXXXXXXXXXXXXXXDD-3'
"SM37"   5'-XXXXXXXXXXXXXXXXXXXXXXXXDD-3'
"SM38"   5'-XXXXXXXXXXXXXXXXXXXXXXXXDD-3'
"SM39"   5'-XXXXXXXXXXXXXXXXXXXXXXXXDD-3'
"SM40"   5'-XXXXXXXXXXXXXXXXXXXXXXXXDD-3'
"SM41"   5'-XXXXXXXXXXXXXXXXXXXXXXXXDD-3'
"SM42"   5'-XXXXXXXXXXXXXXXXXXXXXXXXDD-3'
"SM43"   5'-XXXXXXXXXXXXXXXXXXXXXXXXDD-3'
"SM44"   5'-XXXXXXXXXXXXXXXXXXXXXXXXDD-3'
"SM45",  5'-XXXXXXXXXXXXXXXXXXXXXXXXDD-3'
"SM47"
"SM46"   5'-XXXXXXXXXXXXXXXXXXXXXXXXDD-3'
"SM48"   5'-XXXXXXXXXXXXXXXXXXXXXXXXDD-3'
"SM49"   5'-XXXXXXXXXXXXXXXXXXXXXXXXDD-3'
"SM50"   5'-XXXXXXXXXXXXXXXXXXXXXXXXDD-3'
"SM51"   5'-XXXXXXXXXXXXXXXXXXXXXXXXDD-3'
"SM52"   5'-XXXXXXXXXXXXXXXXXXXXXXXXDD-3'
"SM53"   5'-XXXXXXXXXXXXXXXXXXXXXXXXDD-3'
"SM54"   5'-XXXXXXXXXXXXXXXXXXXXXXXXDD-3'
"SM55"   5'-XXXXXXXXXXXXXXXXXXXXXXXXDD-3'
"SM56"   5'-XXXXXXXXXXXXXXXXXXXXXXXXDD-3'
"SM57"   5'-XXXXXXXXXXXXXXXXXXXXXXXXDD-3'
"SM58"   5'-XXXXXXXXXXXXXXXXXXXXXXXXDD-3'
"SM59"   5'-XXXXXXXXXXXXXXXXXXXXXXXXDD-3'
"SM60"   5'-XXXXXXXXXXXXXXXXXXXXXXXXDD-3'
"SM61"   5'-XXXXXXXXXXXXXXXXXXXXXXXXDD-3'
"SM62"   5'-XXXXXXXXXXXXXXXXXXXXXXXXDD-3'
"SM63"   5'-XXXXXXXXXXXXXXXXXXXXXXXXDD-3'
"SM64"   5'-XXXXXXXXXXXXXXXXXXXXXXXXDD-3'
"SM65"   5'-XXXXXXXXXXXXXXXXXXXXXXXXDD-3'
"SM66"   5'-XXXXXXXXXXXXXXXXXXXXXXXXpDpD-3'
"SM67"   5'-XpXXXXXXXXXXXXXXXXXXXXXXXDD-3'
"SM68"   5'-XpXXXXXXXXXXXXXXXXXXXXXXpDpD-3'
"SM69"   5'-DXXXXXXXXXXXXXXXXXXXXXXXDD-3'
"SM70"   5'-DpXXXXXXXXXXXXXXXXXXXXXXXpDpD-3'
"SM71"   5'-DXDXXXXXXXXXXXXXXXXXXXXXDD-3'
"SM72"   5'-DpXDXXXXXXXXXXXXXXXXXXXXXDD-3'
"SM73"   5'-XXDXXXXXXXXXXDXXXXXXXXXXDD-3'
"SM74"   5'-XpXDXXXXXXXXXDXXXXXXXXXXDD-3'
"SM75"   5'-DXDXXXXDXXXXXDXXXXXDXXXXDD-3'
"SM76"   5'-DpXDXXXXXXXXXDXXXXXDXXXXDD-3'
"SM77"   5'-XpXpXXXXXXXXXXXXXXXXXXXXXDD-3'
"SM78"   5'-XpXpXXXXXXXXXXXXXXXXXXXXXpDpD-3'
"SM79"   5'-DpXpDXXXXXXXXXXXXXXXXXXXXDD-3'
"SM80"   5'-XpXpDXXXXXXXXDXXXXXXXXXXXDD-3'
"SM81"   5'-DXDXXXXDXXXXXDXXXXXDXXXXDD-3'
"SM82"   5'-DpXDXXXDXXXXXDXXXXXDXXXXpDpD-3'
"SM83"   5'C3 spacer-XXXXXXXXXXXXXXXXXXXXXXXXDD-3'
"SM84"   5'C3 spacer-XXDXXXXXXXXXXDXXXXXXXXXXDD-3'
"SM85"   5'C3 spacer-XXXXXXXXXXXXXXX
         XXXXXXpDpD-3'
"SM86"   5'-XXXXXXXXXXXXXXXXXXXXXXXXpDpD-3'
"SM87"   5'-XpXXXXXXXXXXXXXXXXXXXXXXXDD-3'
"SM88"   5'-XpXXXXXXXXXXXXXXXXXXXXXXXpDpD-3'
"SM89"   5'-DXXXXXXXXXXXXXXXXXXXXXXXDD-3'
"SM90"   5'-DpXXXXXXXXXXXXXXXXXXXXXXXpDpD-3'
"SM91"   5'-DXDXXXXXXXXXXXXXXXXXXXXXDD-3'
"SM92"   5'-DpXDXXXXXXXXXXXXXXXXXXXXXDD-3'
"SM93"   5'-XXDXXXXXXXXXXDXXXXXXXXXXDD-3'
"SM94"   5'-XpXDXXXXXXXXXDXXXXXXXXXXDD-3'
"SM95"   5'-DXDXXXXDXXXXXDXXXXXDXXXXDD-3'
"SM96"   5'-DpXDXXXXXXXXXDXXXXXDXXXXDD-3'
"SM97"   5'-XpXpXXXXXXXXXXXXXXXXXXXXXDD-3'
"SM98"   5'-XpXpXXXXXXXXXXXXXXXXXXXXXpDpD-3'
"SM99"   5'-DpXpDXXXXXXXXXXXXXXXXXXXXDD-3'
"SM100"  5'-XpXpDXXXXXXXXDXXXXXXXXXXXDD-3'

"SM101"  5'-DXDXXXXXXXXDXDXXXDDXXDDD-3'
"SM102"  5'-DpXDXXXXDXXXXXDXXXXXDXXXXpDpD-3'
"SM103"  5'C3 spacer-XXXXXXXXXXXXXXXXXXXXXXXXDD-3'
"SM104"  5'C3 spacer-XXDXXXXXXXXXDXXXXXXXXXXDD-3'
"SM105"  5'C3 spacer-XXXXXXXXXXXXXXX
         XXXXXXXXpDpD-3'
"SM106"  5'-XXXXXXXXXXXXXXXXXXXXXXXXDD-3'
"SM107"  5'-XXXXXXXXXXXXXXXXXXXXXXXXDD-3'
"SM108"  5'-XXXXXXXXXXXXXXXXXXXXXXXXDD-3'
"SM110"  5'-XFXXXXXXXXXXXXXXFXXXXXDD-3'
"SM111"  5'-XXXFXFXXXXXXXFXXXXXXXXXDD-3'
"SM112"  5'-XFXFXFXFXXXXFXFXFXFXXXXXDD-3'
"SM113"  5'-XpFXFXFXFXXXXFXFXFXFXXXXXpDpD-3'0
"SM114"  5'-XFXXXXXXXXXXXXXXXXXXXXXDD-3'
"SM115"  5'-XXXXFFXFXXXXFXFXXXXXXXXDD-3'
"SM116"  5'-XFXFXXXXXXXXXXXFXXXXXXXDD-3'
"SM117"  5'-XFXFFFXFXXXXFXFFFXXXXXDD-3'
"SM118"  5'-XFXFXFXFXXXXFXFXFXFXXXXXDD-3'
"SM119"  5'-XpFXFXFXFXXXXFXFXFXFXXXXXpDpD-3'
"SM250"  5'-XXXXXXXXXXXXXXXXXXXXXXXXDD-3'
"SM251"  5'-XXXXXXXXXXXXXXXXXXXXXXXXDD-3'
"SM252"  5'-XXXXXXXXXXXXXXXXXXXXXXXXDD-3'
         5'-XXXXXXXXXXXXXXXXXXXXXXXXXX-3'
         5'-XXXXXXXXXXXXXXXXXXXXXXXXXX-3'
         5'-XXXXXXXXXXXXXXXXXXXXXXXXXX-3'
         5'-XXXXXXXXXXXXXXXXXXXXXXXXXX-3'
         5'-XXXXXXXXXXXXXXXXXXXXXXXXXX-3'
         5'-XXXXXXXXXXXXXXXXXXXXXXXXXX-3'
         5'-XXXXXXXXXXXXXXXXXXXXXXXXXX-3'
         5'-XXXXXXXXXXXXXXXXXXXXXXXXXX-3'
         5'-XXXXXXXXXXXXXXXXXXXXXXXXXX-3'
         5'-XXXXXXXXXXXXXXXXXXXXXXXXXX-3'
         5'-XXXXXXXXXXXXXXXXXXXXXXXXXX-3'
         5'-XXXXXXXXXXXXXXXXXXXXXXXXXX-3'
         5'-XXXXXXXXXXXXXXXXXXXXXXXXXX-3'
         5'-XXXXXXXXXXXXXXXXXXXXXXXXXX-3'
         5'-XXXXXXXXXXXXXXXXXXXXXXXXXX-3'
         5'-XXXXXXXXXXXXXXXXXXXXXXXXXX-3'
         5'-XXXXXXXXXXXXXXXXXXXXXXXXXX-3'
         5'-XXXXXXXXXXXXXXXXXXXXXXXXXX-3'
         5'-XXXXXXXXXXXXXXXXXXXXXXXXXX-3'
         5'-XXXXXXXXXXXXXXXXXXXXXXXXXX-3'
         5'-XXXXXXXXXXXXXXXXXXXXXXXXXX-3'
         5'-XXXXXXXXXXXXXXXXXXXXXXXXXX-3'
         5'-XXXXXXXXXXXXXXXXXXXXXXXXXX-3'
         5'-XXXXXXXXXXXXXXXXXXXXXXXXXX-3'
         5'-XXXXXXXXXXXXXXXXXXXXXXXXXX-3'
         5'-XXXXXXXXXXXXXXXXXXXXXXXXXX-3'
         5'-XXXXXXXXXXXXXXXXXXXXXXXXXX-3'
         5'-XXXXXXXXXXXXXXXXXXXXXXXXXX-3'
         5'-XXXXXXXXXXXXXXXXXXXXXXXXXX-3'
         5'-XXXXXXXXXXXXXXXXXXXXXXXXXX-3'
         5'-XXXXXXXXXXXXXXXXXXXXXXXXXX-3'
         5'-XXXXXXXXXXXXXXXXXXXXXXXXXX-3'
         5'-XXXXXXXXXXXXXXXXXXXXXXXXXX-3'
         5'-XXXXXXXXXXXXXXXXXXXXXXXXXX-3'
         5'-XXXXXXXXXXXXXXXXXXXXXXXXXX-3'
         5'-XXXXXXXXXXXXXXXXXXXXXXXXXX-3'
"SM22"   5'-XXXXXXXXXXXXXXXXXXXXXXXXXX-3'
         5'-XXXXXXXXXXXXXXXXXXXXXXXXXX-3'
         5'-XXXXXXXXXXXXXXXXXXXXXXXXXX-3'
         5'-XXXXXXXXXXXXXXXXXXXXXXXXXX-3'
``` wherein "X", RNA, "X"=2'-O-methyl RNA, "D"=DNA, "F"=2'-Fluoro NA and "p"=Phosphorothioate linkage.

* * * * *